US008013215B2

(12) United States Patent
Damude et al.

(10) Patent No.: US 8,013,215 B2
(45) Date of Patent: Sep. 6, 2011

(54) PRODUCTION OF ARACHIDONIC ACID IN OILSEED PLANTS

(75) Inventors: Howard Glenn Damude, Hockessin, DE (US); Anthony J. Kinney, Wilmington, DE (US)

(73) Assignee: E.I. du Pont de Nemours and Company, Wilmington, DE (US)

( * ) Notice: Subject to any disclaimer, the term of this patent is extended or adjusted under 35 U.S.C. 154(b) by 624 days.

(21) Appl. No.: 12/029,557

(22) Filed: Feb. 12, 2008

(65) Prior Publication Data

US 2008/0194685 A1 Aug. 14, 2008

Related U.S. Application Data

(60) Provisional application No. 60/889,373, filed on Feb. 12, 2007.

(51) Int. Cl.
*A01H 5/00* (2006.01)
*C12N 15/82* (2006.01)
*A23L 1/20* (2006.01)
*A23L 1/36* (2006.01)

(52) U.S. Cl. ......... 800/298; 800/281; 426/629; 426/630

(58) Field of Classification Search ................ None
See application file for complete search history.

(56) References Cited

U.S. PATENT DOCUMENTS

| 5,658,767 | A |   | 8/1997 | Kyle |
| 5,952,544 | A |   | 9/1999 | Browse et al. |
| 6,075,183 | A |   | 6/2000 | Knutzon et al. |
| 2009/0222951 | A1 | * | 9/2009 | Cirpus et al. ............... 800/281 |

FOREIGN PATENT DOCUMENTS

| WO | WO93/11245 | 6/1993 |
| WO | WO 2004057001 A2 * | 7/2004 |
| WO | WO2004/071178 | 8/2004 |
| WO | WO2004/071467 | 8/2004 |
| WO | 2005/012316 | 2/2005 |
| WO | WO2005/047479 | 5/2005 |
| WO | WO2006/012325 | 2/2006 |
| WO | WO2007/061845 | 5/2007 |
| WO | WO2007136877 | 11/2007 |

OTHER PUBLICATIONS

U.S. Appl. No. 60/909,790, filed Apr. 3, 2007, E I. du Pont de Nemours and Company.
U.S. Appl. No. 60/910,831, filed Apr. 10, 2007, E I. du Pont de Nemours and Company.
U.S. Appl. No. 60/911,925, filed Apr. 16, 2007, E I. du Pont de Nemours and Company.
U.S. Appl. No. 60/915,733, filed May 3, 2007, E I. du Pont de Nemours and Company.
U.S. Appl. No. 11/601,563, filed Nov. 16, 2006, E I. du Pont de Nemours and Company.
U.S. Appl. No. 11/737,772, filed Apr. 20, 2007, E I. du Pont de Nemours and Company.
U.S. Appl. No. 11/748,629, filed May 15, 2007, E I. du Pont de Nemours and Company.
U.S. Appl. No. 11/876,115, filed Oct. 22, 2007, E I. du Pont de Nemours and Company.
Bilyeu et al., Mutations in Soybean Microsomal Omega-3 Fatty Acid Desaturase Genes Reduce Linolenic Acid concentration in Soybean Seeds. Crop Science, vol. 45, pp. 1830-1836, Aug. 1, 2005.
National Center for Biotechnology Information General Identifier No. 3859487, Accession No. AF067654, Nov. 11, 1998, D. S. Knutzon et al., Identification of Delta5-desaturase from Mortierella alpina by heterologous expression in Bakers' yeast and canola.
Qi et al, Production of very long chain polyunsaturated omega-3 and omega-6 fatty acids in plants. Nature Biotechnology, vol. 22(6), p. 739-745, Jun. 1, 2004.
Wu et al., Stepwise engineering to produce high yields of very long-chain polyunsaturated fatty acids in plants. Nature Biotechnology, vol. 23(8), p. 1013-1017, Aug. 1, 2005.
Napier, Jonathan A., Transgenic plants as a source of fish oils: healthy, sustainable and GM. Journal of the Science of Food and Agriculture, vol. 87(1), p. 8-12, Oct. 9, 2006.
PCT/US2008/001909 International Search Report, E. I. du Pont de Nemours and Company, Jan. 2009.

* cited by examiner

Primary Examiner — Elizabeth McElwain

(57) ABSTRACT

Oilseed plants which have been transformed to produce arachidonic acid, recombinant constructs used in such transformations, methods for producing arachidonic acid in a plant are described and uses of oils and seeds obtained from such transformed plants in a variety of food and feed applications are described.

11 Claims, 32 Drawing Sheets

FIG. 12

| Construct 1 | Construct 2 | Expected Phenotype |
|---|---|---|
| pKKE2 (SEQ ID NO:40) ATCC Acession Number PTA-4987; see FIG. 14 | pKR226 (SEQ ID NO:9) | ARA, some EPA, some GLA |
| | BC-Tpom_ALS (SEQ ID NO:10) | ARA, some EPA, some GLA, reduced EDA/ERA/SCI/JUN |
| | BC-Tpom_ALSrev (SEQ ID NO:11) | ARA, some EPA, some GLA, reduced EDA/ERA/SCI/JUN |
| | BC-Tpom_Ann-EgD5_ALS (SEQ ID NO:17) | ARA, some EPA, some GLA, reduced DGLA/ETA |
| | BC-Tpom_Ann-EgD5_ALSrev (SEQ ID NO:18) | ARA, some EPA, some GLA, reduced DGLA/ETA |
| | BC-ELfad3_ALS (SEQ ID NO:27) | ARA, no EPA, some GLA |
| | BC-Tpom_Ann-ELfad3_ALS (SEQ ID NO:29) | ARA, no EPA, some GLA, reduced EDA/ERA/SCI/JUN |
| | BC-HPfad3ABA'_ALS (SEQ ID NO:39) | ARA, no EPA, some GLA |
| | BC-Tpom_Ann-HPfad3ABA'_ALS (SEQ ID NO:26) | ARA, some EPA, some GLA, reduced EDA/ERA/SCI/JUN |
| pKR1084 (SEQ ID NO:7) – described in Example 4 | BC-Tpom_ALS (SEQ ID NO:74) | ARA, some EPA, no GLA |
| | BC-Tpom_ALSrev (SEQ ID NO:11) | ARA, some EPA, no GLA |
| | BC-Tpom_Ann-EgD5_ALS (SEQ ID NO:17) | ARA, some EPA, no GLA, reduced DGLA/ETA |
| | BC-Tpom_Ann-EgD5_ALSrev (SEQ ID NO:18) | ARA, some EPA, no GLA, reduced DGLA/ETA |
| | BC-ELfad3_ALS (SEQ ID NO:29) | ARA, no EPA, no GLA |
| | BC-Tpom_Ann-HPfad3ABA'_ALS (SEQ ID NO:26) | ARA, no EPA, no GLA |
| pKR973 (SEQ ID NO:41) | pKR226 (SEQ ID NO:9) | ARA, some EPA, no GLA |
| | BC-Tpom_ALS (SEQ ID NO:10) | ARA, some EPA, no GLA, reduced EDA/ERA/SCI/JUN |
| | BC-Tpom_ALSrev (SEQ ID NO:11) | ARA, some EPA, no GLA, reduced EDA/ERA/SCI/JUN |
| | BC-Tpom_Ann-EgD5_ALS (SEQ ID NO:17) | ARA, some EPA, no GLA, reduced EDA/ERA/SCI/JUN, reduced DGLA/ETA |
| | BC-Tpom_Ann-EgD5_ALSrev (SEQ ID NO:18) | ARA, some EPA, no GLA, reduced EDA/ERA/SCI/JUN, reduced DGLA/ETA |
| | BC-ELfad3_ALS (SEQ ID NO:27) | ARA, no EPA, no GLA |
| | BC-Tpom_Ann-ELfad3_ALS (SEQ ID NO:29) | ARA, no EPA, no GLA, reduced EDA/ERA/SCI/JUN |
| | BC-HPfad3ABA'_ALS (SEQ ID NO:39) | ARA, no EPA, no GLA |
| | BC-Tpom_Ann-HPfad3ABA'_ALS (SEQ ID NO:26) | ARA, no EPA, no GLA, reduced EDA/ERA/SCI/JUN |

FIG. 17

| Event No. | 16:0 | 18:0 | 18:1 | LA | GLA | ALA | EDA | DGLA | ARA | ERA | JUN | ETA | EPA | DPA | Other | Ave. ARA | Ave. EPA |
|---|---|---|---|---|---|---|---|---|---|---|---|---|---|---|---|---|---|
| 4828-4-18-1 | 15.4 | 2.0 | 11.0 | 24.8 | 0.9 | 9.9 | 3.9 | 4.8 | 16.6 | 0.9 | 1.7 | 1.1 | 4.5 | 0.0 | 2.4 | 13.2 | 3.6 |
| 4828-4-18-2 | 15.0 | 2.0 | 13.2 | 25.7 | 0.0 | 13.3 | 2.6 | 4.2 | 13.9 | 0.9 | 1.3 | 0.9 | 4.0 | 0.0 | 2.8 | | |
| 4828-4-18-3 | 15.3 | 1.3 | 10.9 | 29.9 | 0.0 | 18.4 | 1.1 | 4.3 | 10.8 | 0.7 | 1.0 | 0.9 | 2.9 | 0.0 | 2.4 | | |
| 4828-4-18-5 | 15.4 | 1.7 | 10.2 | 20.1 | 1.2 | 4.6 | 6.9 | 8.1 | 20.3 | 1.0 | 1.3 | 1.3 | 5.5 | 0.0 | 2.4 | | |
| 4828-4-18-6 | 15.7 | 1.5 | 9.4 | 29.3 | 0.0 | 17.1 | 2.2 | 4.8 | 12.0 | 1.0 | 1.3 | 0.7 | 3.6 | 0.0 | 1.4 | | |
| 4828-4-18-7 | 16.0 | 1.3 | 10.1 | 32.4 | 0.4 | 10.9 | 3.5 | 5.0 | 12.0 | 0.8 | 1.1 | 0.8 | 3.2 | 0.0 | 2.5 | | |
| 4828-4-18-8 | 15.0 | 1.8 | 16.1 | 25.5 | 0.0 | 17.2 | 1.6 | 3.6 | 12.2 | 0.5 | 1.0 | 0.7 | 3.3 | 0.0 | 1.5 | | |
| 4828-4-18-9 | 14.7 | 1.7 | 10.8 | 31.5 | 0.3 | 6.2 | 8.5 | 5.9 | 11.3 | 1.3 | 1.6 | 0.7 | 2.8 | 0.0 | 2.3 | | |
| 4828-4-18-10 | 15.7 | 1.4 | 9.0 | 34.8 | 1.0 | 13.3 | 3.6 | 4.8 | 9.5 | 0.6 | 0.7 | 0.6 | 2.2 | 0.0 | 2.9 | | |

FIG. 26

| Event No. | 16:0 | 18:0 | 18:1 | LA | ALA |
|---|---|---|---|---|---|
| Typical wt Embryo | 17.5 | 3.6 | 6.9 | 43.5 | 28.6 |
| 2148-4-12-1 | 15.8 | 3.6 | 12.3 | 53.9 | 14.4 |
| 2148-2-10-1 | 18.0 | 3.7 | 11.5 | 51.1 | 15.7 |
| 2148-2-5-1 | 18.8 | 3.3 | 8.9 | 52.8 | 16.1 |
| 2148-4-13-1 | 16.0 | 3.7 | 13.2 | 50.9 | 16.2 |
| 2148-2-8-1 | 17.5 | 3.4 | 9.6 | 53.2 | 16.3 |
| 2165-4-1-1 | 19.4 | 3.5 | 9.1 | 56.0 | 12.0 |
| 2165-1-13-1 | 18.5 | 3.4 | 10.5 | 55.0 | 12.6 |
| 2165-4-2-1 | 17.1 | 3.0 | 10.0 | 57.2 | 12.7 |
| 2165-1-5-1 | 17.3 | 3.8 | 11.8 | 54.0 | 13.1 |
| 2165-1-2-1 | 18.2 | 4.3 | 9.1 | 54.8 | 13.6 |

FIG. 27

| Event No. | 16:0 | 18:0 | 18:1 | LA | ALA | EDA | DGLA | ERA | ETA |
|---|---|---|---|---|---|---|---|---|---|
| 2144-1-3-1 | 19.1 | 2.1 | 7.6 | 29.9 | 20.2 | 1.8 | 12.2 | 0.9 | 6.2 |
| 2144-1-3-2 | 19.7 | 2.4 | 6.5 | 29.6 | 18.1 | 2.4 | 13.8 | 1.0 | 6.6 |
| 2144-1-3-3 | 18.9 | 2.5 | 7.6 | 29.4 | 16.9 | 4.0 | 13.4 | 1.2 | 6.1 |
| 2144-1-3-4 | 19.2 | 2.9 | 6.3 | 27.4 | 17.0 | 5.1 | 14.2 | 1.5 | 6.4 |
| Ave. | 19.2 | 2.5 | 7.0 | 29.1 | 18.0 | 3.3 | 13.4 | 1.1 | 6.3 |
| 2144-1-7-1 | 18.1 | 1.9 | 8.4 | 33.1 | 18.1 | 2.0 | 12.7 | 0.6 | 5.1 |
| 2144-1-7-2 | 18.7 | 2.2 | 7.9 | 32.3 | 16.8 | 2.1 | 13.9 | 0.7 | 5.4 |
| 2144-1-7-3 | 18.0 | 1.7 | 8.1 | 34.5 | 18.4 | 2.1 | 11.6 | 0.6 | 4.8 |
| 2144-1-7-4 | 18.5 | 2.0 | 7.8 | 33.5 | 18.2 | 2.2 | 12.3 | 0.8 | 4.7 |
| Ave. | 18.3 | 1.9 | 8.1 | 33.3 | 17.9 | 2.1 | 12.6 | 0.7 | 5.0 |
| 2144-1-9-1 | 16.9 | 2.7 | 13.4 | 28.4 | 10.6 | 4.0 | 17.2 | 0.8 | 6.0 |
| 2144-1-9-2 | 18.3 | 2.5 | 8.9 | 28.3 | 16.8 | 4.3 | 13.6 | 1.3 | 5.9 |
| 2144-1-9-3 | 19.7 | 2.4 | 8.7 | 28.5 | 19.2 | 3.9 | 11.0 | 1.4 | 5.2 |
| 2144-1-9-4 | 18.4 | 1.8 | 7.5 | 34.1 | 21.1 | 2.4 | 9.2 | 0.9 | 4.6 |
| Ave. | 18.3 | 2.3 | 9.6 | 29.8 | 16.9 | 3.7 | 12.7 | 1.1 | 5.4 |
| 2144-1-10-1 | 18.2 | 2.9 | 9.1 | 28.7 | 11.0 | 7.2 | 15.8 | 1.3 | 5.8 |
| 2144-1-10-2 | 17.8 | 2.9 | 9.4 | 31.6 | 13.0 | 7.8 | 11.7 | 1.4 | 4.4 |
| 2144-1-10-3 | 18.2 | 2.2 | 8.0 | 34.1 | 16.6 | 3.8 | 11.3 | 1.1 | 4.6 |
| 2144-1-10-4 | 17.9 | 2.0 | 6.6 | 34.9 | 17.5 | 3.1 | 12.1 | 0.9 | 4.9 |
| Ave. | 18.1 | 2.5 | 8.3 | 32.3 | 14.5 | 5.5 | 12.7 | 1.2 | 4.9 |
| 2144-2-3-1 | 18.7 | 1.8 | 7.0 | 30.2 | 16.4 | 2.9 | 16.6 | 0.8 | 5.6 |
| 2144-2-3-2 | 17.8 | 1.5 | 5.9 | 30.5 | 18.0 | 1.8 | 16.9 | 0.6 | 7.0 |
| 2144-2-3-3 | 16.8 | 1.2 | 6.3 | 29.7 | 23.0 | 0.8 | 14.9 | 0.3 | 7.1 |
| 2144-2-3-4 | 17.5 | 1.7 | 7.1 | 31.0 | 18.1 | 2.3 | 15.1 | 0.7 | 6.5 |
| Ave. | 17.7 | 1.5 | 6.6 | 30.3 | 18.9 | 2.0 | 15.9 | 0.6 | 6.5 |

| | 16:0 | 18:0 | 18:1 | LA | ALA | EDA | SCI | DGLA | ARA | ERA | JUN | ETA | EPA | Other | Total n-3 |
|---|---|---|---|---|---|---|---|---|---|---|---|---|---|---|---|
| AFS 5452-7-4 | 14.3 | 3.9 | 10.7 | 18.4 | 1.6 | 9.2 | 0.4 | 7.6 | 29.0 | 0.4 | 0.0 | 0.2 | 2.1 | 2.1 | 4.3 |
| AFS 5452-5-6 | 16.5 | 3.1 | 13.6 | 17.3 | 2.2 | 8.8 | 3.2 | 3.8 | 25.2 | 0.7 | 0.7 | 0.4 | 2.5 | 2.1 | 6.6 |
| AFS 5452-3-8 | 13.7 | 3.0 | 12.7 | 23.2 | 1.8 | 11.0 | 0.7 | 5.6 | 24.0 | 0.4 | 0.1 | 0.2 | 1.9 | 1.7 | 4.5 |
| AFS 5416-8-4 | 15.3 | 2.5 | 18.1 | 20.3 | 4.7 | 3.3 | 2.6 | 2.7 | 23.1 | 0.4 | 0.4 | 0.1 | 2.9 | 3.5 | 8.6 |
| AFS 5450-4-3 | 14.9 | 2.9 | 17.4 | 21.0 | 2.9 | 7.3 | 0.4 | 5.7 | 22.5 | 0.4 | 0.2 | 0.3 | 1.9 | 2.2 | 5.7 |
| AFS 5425-8-2 | 15.1 | 2.1 | 17.2 | 22.6 | 8.6 | 2.7 | 0.1 | 3.6 | 21.6 | 0.2 | 0.0 | 0.3 | 3.0 | 2.8 | 12.2 |
| AFS 5450-1-7 | 15.1 | 2.8 | 18.0 | 23.5 | 3.2 | 6.3 | 1.2 | 4.0 | 21.3 | 0.3 | 0.0 | 0.1 | 2.2 | 2.0 | 5.8 |
| AFS 5450-8-5 | 15.8 | 2.8 | 17.9 | 18.6 | 4.4 | 6.9 | 1.7 | 5.3 | 21.1 | 0.5 | 0.1 | 0.3 | 2.6 | 2.0 | 7.8 |
| AFS 5425-4-2 | 15.4 | 2.8 | 17.4 | 23.2 | 5.5 | 5.1 | 1.4 | 2.5 | 20.8 | 0.4 | 0.4 | 0.1 | 2.3 | 2.6 | 8.7 |
| AFS 5450-1-1 | 17.3 | 2.6 | 15.2 | 25.3 | 4.9 | 5.3 | 1.6 | 2.9 | 20.0 | 0.4 | 0.3 | 0.3 | 1.7 | 2.3 | 7.6 |
| AFS 5450-3-4 | 15.8 | 2.5 | 14.0 | 25.4 | 4.1 | 9.7 | 2.0 | 2.4 | 19.6 | 0.6 | 0.4 | 0.1 | 2.0 | 1.3 | 7.2 |
| AFS 5425-3-4 | 14.5 | 3.6 | 16.1 | 18.1 | 4.3 | 5.7 | 0.6 | 10.9 | 19.6 | 0.4 | 0.3 | 0.0 | 1.8 | 3.4 | 7.5 |
| AFS 5450-5-2 | 13.9 | 3.3 | 22.0 | 19.0 | 2.1 | 8.8 | 0.3 | 6.4 | 19.2 | 0.5 | 0.3 | 0.8 | 1.4 | 2.5 | 4.6 |
| AFS 5425-4-1 | 14.8 | 3.0 | 18.2 | 22.2 | 6.4 | 6.2 | 0.4 | 4.3 | 19.0 | 0.4 | 0.0 | 0.3 | 2.1 | 2.7 | 9.2 |
| AFS 5425-4-3 | 14.6 | 2.7 | 15.4 | 26.3 | 9.6 | 4.6 | 0.8 | 2.0 | 17.9 | 0.6 | 0.2 | 0.1 | 2.6 | 2.7 | 13.2 |
| AFS 5425-8-1 | 16.2 | 1.7 | 14.7 | 28.4 | 9.2 | 2.1 | 0.1 | 5.2 | 17.1 | 0.2 | 0.0 | 0.4 | 2.2 | 2.4 | 12.1 |
| AFS 5416-8-2 | 14.5 | 3.7 | 18.8 | 22.1 | 5.4 | 5.6 | 1.1 | 3.8 | 17.1 | 0.7 | 0.6 | 0.2 | 3.4 | 3.1 | 10.3 |
| AFS 5416-8-1 | 15.2 | 2.6 | 19.2 | 24.6 | 4.6 | 5.2 | 1.2 | 4.5 | 17.0 | 0.4 | 0.3 | 0.6 | 1.5 | 2.9 | 7.5 |
| AFS 5450-2-7 | 16.0 | 3.2 | 18.4 | 19.9 | 3.1 | 6.3 | 0.8 | 9.8 | 16.8 | 0.3 | 0.2 | 0.7 | 1.6 | 2.9 | 5.8 |
| AFS 5450-3-1 | 14.8 | 3.7 | 16.6 | 21.2 | 6.6 | 9.0 | 1.0 | 3.0 | 15.8 | 1.5 | 0.6 | 0.5 | 4.2 | 1.6 | 13.3 |

| | 16:0 | 18:0 | 18:1 | LA | ALA | EDA | SCI | DGLA | ARA | ERA | JUN | ETA | EPA | Other | Total n-3 |
|---|---|---|---|---|---|---|---|---|---|---|---|---|---|---|---|
| AFS 5416-8-1-1 | 14.7 | 2.8 | 18.6 | 14.6 | 1.4 | 9.3 | 0.8 | 8.8 | 21.8 | 0.8 | 0.2 | 0.7 | 2.4 | 3.3 | 5.4 |
| AFS 5416-8-1-2 | 16.9 | 1.6 | 22.5 | 16.6 | 3.8 | 4.4 | 3.9 | 1.3 | 21.5 | 0.7 | 1.0 | 2.8 | 0.2 | 2.6 | 8.6 |
| AFS 5416-8-1-3 | 14.5 | 2.2 | 21.6 | 15.4 | 2.1 | 2.5 | 0.3 | 6.9 | 26.8 | 0.3 | 0.1 | 0.5 | 2.8 | 3.9 | 5.8 |
| AFS 5416-8-1-4 | 16.0 | 1.2 | 11.8 | 42.1 | 13.2 | 1.0 | 0.8 | 0.7 | 8.6 | 0.2 | 0.2 | 1.2 | 0.2 | 2.9 | 15.0 |
| AFS 5416-8-1-5 | 13.9 | 3.7 | 17.8 | 17.6 | 1.6 | 7.7 | 0.6 | 6.1 | 25.5 | 0.4 | 0.1 | 0.3 | 2.3 | 2.4 | 4.7 |
| AFS 5416-8-1-6 | 17.1 | 2.3 | 13.4 | 41.5 | 5.6 | 5.6 | 1.3 | 1.7 | 8.0 | 0.4 | 0.4 | 0.0 | 1.1 | 1.6 | 7.4 |
| AFS 5416-8-1-7 | 13.4 | 3.3 | 16.4 | 18.2 | 1.6 | 6.4 | 0.5 | 9.4 | 25.0 | 0.3 | 0.1 | 0.4 | 2.0 | 3.1 | 4.4 |
| AFS 5416-8-1-8 | 17.3 | 2.1 | 18.6 | 26.9 | 9.2 | 3.5 | 1.7 | 2.1 | 12.6 | 0.5 | 0.5 | 0.2 | 1.5 | 3.3 | 12.0 |
| AFS 5416-8-1-9 | 13.0 | 3.7 | 34.4 | 18.0 | 1.7 | 5.7 | 0.2 | 6.3 | 10.5 | 0.4 | 0.1 | 0.3 | 1.6 | 4.0 | 4.1 |
| AFS 5416-8-1-10 | 14.8 | 3.2 | 17.1 | 35.4 | 5.8 | 5.7 | 1.9 | 2.0 | 9.8 | 0.4 | 0.4 | 0.0 | 1.3 | 2.2 | 7.9 |
| | 15.2 | 2.6 | 19.2 | 24.6 | 4.6 | 5.2 | 1.2 | 4.5 | 17.0 | 0.4 | 0.3 | 0.6 | 1.5 | 2.9 | 7.5 |

FIG. 30

| | 16:0 | 18:0 | 18:1 | LA | ALA | EDA | SCI | DGLA | ARA | ERA | JUN | ETA | EPA | Other | Total n-3 |
|---|---|---|---|---|---|---|---|---|---|---|---|---|---|---|---|
| AFS 5430-6-5 | 16.5 | 1.7 | 12.4 | 12.0 | 3.4 | 1.5 | 0.1 | 11.9 | 29.4 | 0.1 | 0.3 | 0.6 | 3.6 | 6.6 | 7.9 |
| AFS 5430-3-13 | 12.3 | 2.0 | 14.4 | 24.5 | 5.5 | 3.4 | 2.2 | 1.4 | 28.0 | 0.3 | 0.1 | 0.2 | 2.9 | 2.9 | 9.0 |
| AFS 5430-4-7 | 15.4 | 2.4 | 15.3 | 18.1 | 4.9 | 3.3 | 0.7 | 4.3 | 27.6 | 0.5 | 0.2 | 0.4 | 3.7 | 3.3 | 9.6 |
| AFS 5430-7-4 | 16.5 | 2.3 | 14.9 | 18.4 | 5.0 | 3.5 | 0.2 | 5.9 | 25.5 | 0.3 | 0.1 | 1.0 | 3.2 | 3.1 | 9.7 |
| AFS 5430-3-6 | 14.3 | 2.9 | 17.3 | 17.8 | 3.0 | 5.5 | 0.4 | 6.3 | 25.4 | 0.4 | 0.1 | 0.4 | 2.8 | 3.4 | 6.7 |
| AFS 5430-7-5 | 14.9 | 3.3 | 15.3 | 20.0 | 4.6 | 5.5 | 2.2 | 2.7 | 24.9 | 0.5 | 0.6 | 0.2 | 3.0 | 2.3 | 8.9 |
| AFS 5430-4-2 | 16.2 | 2.6 | 16.4 | 19.2 | 3.9 | 4.6 | 1.1 | 3.3 | 24.8 | 0.5 | 0.3 | 0.3 | 3.3 | 3.6 | 8.3 |
| AFS 5430-1-5 | 13.7 | 2.8 | 15.2 | 22.0 | 2.5 | 7.2 | 0.6 | 5.7 | 23.9 | 0.5 | 0.2 | 0.4 | 2.5 | 2.9 | 6.0 |
| AFS 5430-2-7 | 14.2 | 2.9 | 15.0 | 23.8 | 4.2 | 5.8 | 1.3 | 3.2 | 23.8 | 0.5 | 0.3 | 0.2 | 2.8 | 2.0 | 8.0 |
| AFS 5430-7-2 | 14.8 | 3.1 | 21.2 | 16.1 | 3.8 | 4.1 | 0.8 | 4.5 | 23.7 | 0.4 | 0.2 | 0.4 | 3.6 | 3.2 | 8.5 |
| AFS 5430-3-1 | 14.8 | 3.0 | 19.9 | 17.5 | 3.0 | 6.0 | 0.8 | 4.8 | 23.2 | 0.4 | 0.2 | 0.3 | 2.6 | 3.3 | 6.6 |
| AFS 5430-6-2 | 15.8 | 2.7 | 14.4 | 23.4 | 4.6 | 6.5 | 0.7 | 4.0 | 22.8 | 0.2 | 0.1 | 0.3 | 2.3 | 2.0 | 7.7 |
| AFS 5430-3-3 | 13.8 | 2.6 | 18.0 | 21.1 | 4.1 | 4.6 | 0.5 | 7.0 | 22.6 | 0.4 | 0.2 | 0.2 | 1.5 | 3.7 | 6.2 |
| AFS 5430-1-9 | 14.0 | 3.0 | 19.9 | 18.7 | 4.5 | 5.2 | 0.5 | 5.0 | 22.5 | 0.4 | 0.1 | 0.3 | 2.7 | 3.1 | 8.0 |
| AFS 5430-1-2 | 15.3 | 2.7 | 14.7 | 22.0 | 4.8 | 6.3 | 0.6 | 4.1 | 22.5 | 0.6 | 0.2 | 0.4 | 2.9 | 3.0 | 8.9 |
| AFS 5430-1-11 | 14.8 | 2.7 | 18.1 | 19.4 | 2.2 | 6.5 | 0.5 | 6.8 | 22.4 | 0.5 | 0.2 | 0.4 | 2.3 | 3.2 | 5.6 |
| AFS 5430-4-4 | 15.2 | 2.5 | 16.1 | 20.4 | 2.9 | 9.1 | 0.7 | 4.5 | 22.2 | 0.7 | 0.2 | 0.4 | 3.1 | 2.1 | 7.3 |
| AFS 5430-1-17 | 15.5 | 2.6 | 14.2 | 22.5 | 6.1 | 3.8 | 1.2 | 2.2 | 21.8 | 0.6 | 0.4 | 0.2 | 3.5 | 5.5 | 10.8 |
| AFS 5430-3-14 | 14.9 | 3.0 | 16.4 | 20.8 | 5.6 | 4.6 | 2.0 | 3.1 | 21.6 | 0.6 | 0.5 | 0.3 | 3.7 | 3.0 | 10.8 |
| AFS 5430-2-1 | 13.4 | 3.7 | 21.7 | 14.3 | 3.6 | 5.9 | 1.0 | 5.7 | 21.0 | 0.8 | 0.4 | 0.5 | 4.5 | 3.6 | 9.8 |

FIG. 31

| | 16:0 | 18:0 | 18:1 | LA | ALA | 20:1 | EDA | DGLA | ARA | ERA | ETA | EPA | Other | Total n-3 |
|---|---|---|---|---|---|---|---|---|---|---|---|---|---|---|
| ff1194-2 | 9.1 | 2.7 | 23.3 | 40.0 | 1.6 | 2.1 | 12.1 | 1.7 | 4.4 | 0.9 | 0.2 | 0.2 | 1.6 | 4.5 |
| ff1194-3 | 9.3 | 3.2 | 22.8 | 40.4 | 1.0 | 2.5 | 12.9 | 1.1 | 4.3 | 0.7 | 0.1 | 0.1 | 1.4 | 3.4 |
| ff1194-4 | 9.3 | 3.1 | 22.1 | 36.9 | 0.8 | 3.7 | 12.6 | 1.6 | 6.8 | 0.9 | 0.1 | 0.3 | 1.6 | 3.8 |
| ff1194-5 | 8.2 | 2.8 | 23.5 | 40.1 | 0.9 | 4.1 | 12.9 | 1.1 | 4.2 | 0.7 | 0.1 | 0.1 | 1.2 | 3.0 |
| ff1194-6 | 10.1 | 3.1 | 14.9 | 30.2 | 11.7 | 14.9 | 7.3 | 1.2 | 2.9 | 1.0 | 0.2 | 0.2 | 1.9 | 15.0 |
| ff1194-7 | 9.4 | 3.2 | 20.2 | 30.6 | 0.6 | 3.9 | 18.9 | 3.4 | 6.8 | 1.1 | 0.2 | 0.3 | 1.3 | 3.4 |
| ff1194-8 | 8.4 | 3.0 | 22.2 | 29.2 | 0.7 | 6.7 | 17.2 | 2.2 | 6.8 | 1.1 | 0.2 | 0.3 | 1.8 | 4.0 |
| ff1194-9 | 8.0 | 2.7 | 20.6 | 34.4 | 0.6 | 3.9 | 21.0 | 1.2 | 4.2 | 0.8 | 0.2 | 0.1 | 2.2 | 3.9 |
| ff1194-10 | 9.0 | 3.0 | 21.7 | 37.6 | 1.2 | 2.5 | 14.8 | 1.7 | 4.9 | 1.4 | 0.2 | 0.3 | 1.5 | 4.6 |
| ff1194-11 | 9.1 | 3.4 | 24.4 | 40.9 | 0.9 | 1.4 | 13.3 | 1.0 | 3.2 | 0.9 | 0.1 | 0.1 | 1.2 | 3.2 |
| ff1194-12 | 8.5 | 2.8 | 26.7 | 39.0 | 0.7 | 3.8 | 9.7 | 4.5 | 2.2 | 0.5 | 0.3 | 0.0 | 1.1 | 2.7 |
| ff1194-13 | 8.3 | 3.1 | 23.1 | 37.2 | 0.5 | 2.7 | 16.9 | 1.2 | 4.4 | 0.9 | 0.1 | 0.1 | 1.2 | 2.8 |
| ff1194-14 | 8.6 | 3.1 | 19.3 | 38.2 | 0.6 | 2.9 | 20.8 | 0.8 | 3.2 | 1.1 | 0.1 | 0.1 | 1.2 | 3.1 |
| ff1194-15 | 10.0 | 3.0 | 16.2 | 28.2 | 0.6 | 3.0 | 24.7 | 4.4 | 5.2 | 1.6 | 0.4 | 0.2 | 2.3 | 5.0 |
| ff1194-16 | 9.6 | 3.3 | 22.5 | 20.4 | 0.2 | 6.7 | 19.6 | 3.4 | 10.4 | 1.2 | 0.3 | 0.4 | 1.8 | 3.9 |
| ff1194-17 | 11.0 | 3.5 | 17.4 | 32.0 | 1.2 | 2.7 | 17.2 | 2.7 | 7.2 | 1.4 | 0.3 | 0.3 | 2.8 | 5.9 |
| ff1194-18 | 9.7 | 3.1 | 21.4 | 28.7 | 0.6 | 4.5 | 15.6 | 2.7 | 9.4 | 1.2 | 0.3 | 0.5 | 2.0 | 4.6 |
| ff1194-19 | 9.2 | 3.1 | 20.0 | 38.2 | 0.8 | 2.3 | 16.9 | 1.5 | 5.3 | 1.0 | 0.1 | 0.2 | 1.1 | 3.3 |

FIG. 32

| | 16:0 | 18:0 | 18:1 | LA | GLA | ALA | STA | 20:1 | EDA | DGLA | ARA | ERA | ETA | EPA | DPA | Other | Total n-3 (>18:3) | Total n-3 |
|---|---|---|---|---|---|---|---|---|---|---|---|---|---|---|---|---|---|---|
| ff1194-16-1 | 11.0 | 3.9 | 16.1 | 15.0 | 0.0 | 0.0 | 0.0 | 6.9 | 26.8 | 3.0 | 15.8 | 1.4 | 0.0 | 0.0 | 0.0 | 0.0 | 0.0 | 1.4 |
| ff1194-16-2 | 10.9 | 4.5 | 16.2 | 18.2 | 0.0 | 0.0 | 0.0 | 6.7 | 23.9 | 3.7 | 13.2 | 1.6 | 0.0 | 0.0 | 0.0 | 1.2 | 0.0 | 1.6 |
| ff1194-16-3 | 9.5 | 4.4 | 19.3 | 21.0 | 0.0 | 0.0 | 0.0 | 8.1 | 21.9 | 4.6 | 8.7 | 1.4 | 0.0 | 0.0 | 0.0 | 1.1 | 0.0 | 1.4 |
| ff1194-16-4 | 8.3 | 3.3 | 25.0 | 16.1 | 0.0 | 0.0 | 0.0 | 9.3 | 20.9 | 4.6 | 6.3 | 0.9 | 0.0 | 0.0 | 0.0 | 5.3 | 0.0 | 0.9 |
| ff1194-16-5 | 7.2 | 2.8 | 27.1 | 21.0 | 0.0 | 0.0 | 0.0 | 11.1 | 19.8 | 1.6 | 6.1 | 1.0 | 0.0 | 0.0 | 0.0 | 2.4 | 0.0 | 1.0 |
| ff1194-16-6 | 7.5 | 2.7 | 27.9 | 19.4 | 0.0 | 0.0 | 0.0 | 11.0 | 19.1 | 3.2 | 5.5 | 1.0 | 0.2 | 0.3 | 0.0 | 2.2 | 0.5 | 1.5 |
| ff1194-16-7 | 7.7 | 2.8 | 29.0 | 23.3 | 0.0 | 0.0 | 0.0 | 9.4 | 18.4 | 1.6 | 5.3 | 0.7 | 0.0 | 0.3 | 0.0 | 1.5 | 0.3 | 1.0 |
| ff1194-16-8 | 7.6 | 3.0 | 29.4 | 21.9 | 0.0 | 0.0 | 0.0 | 10.1 | 20.5 | 2.8 | 4.8 | 0.0 | 0.0 | 0.0 | 0.0 | 0.0 | 0.0 | 0.0 |
| ff1194-16-9 | 6.9 | 2.6 | 24.1 | 34.1 | 0.0 | 0.0 | 0.0 | 3.9 | 18.0 | 2.6 | 3.9 | 0.8 | 0.0 | 0.0 | 0.0 | 3.1 | 0.0 | 0.8 |
| ff1194-16-10 | 8.4 | 2.2 | 29.5 | 56.4 | 0.0 | 1.4 | 0.0 | 0.0 | 0.0 | 0.0 | 0.0 | 0.0 | 0.0 | 0.0 | 0.0 | 2.2 | 0.0 | 1.4 |
| ff1194-18-1 | 10.5 | 3.2 | 19.1 | 22.0 | 0.0 | 0.0 | 0.0 | 6.6 | 22.5 | 1.6 | 12.4 | 1.3 | 0.0 | 0.0 | 0.0 | 0.8 | 0.0 | 1.3 |
| ff1194-18-2 | 9.3 | 3.8 | 19.2 | 25.9 | 0.0 | 0.4 | 0.0 | 5.7 | 19.2 | 2.0 | 10.7 | 1.3 | 0.0 | 0.7 | 0.0 | 1.8 | 0.7 | 2.4 |
| ff1194-18-3 | 8.7 | 3.8 | 30.0 | 13.5 | 0.0 | 0.0 | 0.0 | 8.0 | 19.5 | 3.9 | 9.5 | 1.4 | 0.0 | 0.0 | 0.0 | 1.7 | 0.0 | 1.4 |
| ff1194-18-4 | 9.6 | 4.1 | 32.4 | 13.7 | 0.0 | 0.0 | 0.0 | 8.1 | 17.7 | 4.2 | 8.7 | 1.5 | 0.0 | 0.0 | 0.0 | 0.0 | 0.0 | 1.5 |
| ff1194-18-5 | 8.4 | 3.4 | 22.2 | 23.8 | 0.0 | 0.0 | 0.0 | 8.0 | 21.4 | 2.5 | 8.0 | 1.0 | 0.0 | 0.0 | 0.0 | 1.4 | 0.0 | 1.0 |
| ff1194-18-6 | 7.3 | 3.1 | 28.9 | 25.3 | 0.0 | 0.0 | 0.0 | 8.8 | 17.4 | 1.3 | 6.1 | 0.8 | 0.0 | 0.0 | 0.0 | 1.0 | 0.0 | 0.8 |
| ff1194-18-7 | 10.3 | 4.2 | 33.1 | 14.4 | 0.0 | 0.0 | 0.0 | 6.5 | 19.9 | 4.2 | 5.9 | 1.6 | 0.0 | 0.0 | 0.0 | 0.0 | 0.0 | 1.6 |
| ff1194-18-8 | 6.9 | 2.9 | 29.8 | 23.7 | 0.0 | 0.0 | 0.0 | 9.8 | 17.0 | 1.7 | 5.6 | 0.8 | 0.0 | 0.3 | 0.0 | 1.5 | 0.3 | 1.1 |
| ff1194-18-9 | 7.8 | 2.8 | 31.1 | 56.0 | 0.0 | 1.0 | 0.0 | 0.4 | 0.0 | 0.0 | 0.0 | 0.0 | 0.0 | 0.2 | 0.0 | 0.6 | 0.2 | 1.2 |
| ff1194-18-10 | 9.2 | 2.3 | 28.3 | 58.1 | 0.0 | 1.3 | 0.0 | 0.0 | 0.0 | 0.0 | 0.0 | 0.0 | 0.0 | 0.0 | 0.0 | 0.7 | 0.0 | 1.3 |

PRODUCTION OF ARACHIDONIC ACID IN OILSEED PLANTS

This application claims the benefit of U.S. Provisional Application No. 60/889,373, filed Feb. 12, 2007, the entire content of which is herein incorporated by reference.

FIELD OF THE INVENTION

This invention is in the field of biotechnology. More specifically, this invention pertains to oilseed plants which have been transformed to produce high levels of arachidonic acid (an omega-6 fatty acid) and a reduced content of omega-3 fatty acids.

BACKGROUND OF THE INVENTION

Two main families of polyunsaturated fatty acids (PUFAs) are the omega-3 fatty acids such as eicosapentaenoic acid (EPA) and the omega-6 fatty acids such as arachidonic acid (ARA; cis-5,8,11,14-eicosatetraenoic). ARA is an important precursor in the production of eicosanoids (e.g., prostaglandins, thromboxanes, prostacyclin and leukotrienes). Additionally, ARA is recognized as: (1) an essential long-chain polyunsaturated fatty acid (PUFA); (2) the principal omega-6 fatty acid found in the human brain; and, (3) an important component of breast milk and many infant formulas, based on its role in early neurological and visual development.

Adults obtain ARA readily from foods such as meat, eggs and milk. Adults also can synthesize ARA from dietary gamma-linolenic acid albeit inefficiently. Commercial sources of ARA oil are typically produced from highly refined and purified fish oil or fermentation (e.g., using microorganisms in the genera *Mortierella* (filamentous fungus), *Entomophthora, Pythium* and *Porphyridium* (red alga)). Most notably, Martek Biosciences Corporation (Columbia, Md.) produces an ARA-containing fungal oil (ARASCO®; see U.S. Pat. No. 5,658,767) which is substantially free of EPA and which is derived from either *Mortierella alpina* or *Pythium insidiuosum*. One of the primary markets for this oil is infant formula.

Unfortunately, there are several disadvantages associated with commercial production of PUFAs (such as ARA) from natural sources. Natural sources of PUFAs, such as fish, tend to have highly heterogeneous oil compositions. The oils obtained from these sources can require extensive purification to separate out one or more desired PUFAs or to produce an oil which is enriched in one or more PUFAs. Natural sources also are subject to uncontrollable fluctuations in availability. Fish stocks may undergo natural variation or may be depleted by overfishing. Fish oils have unpleasant tastes and odors which may be difficult, if not impossible, to economically separate from the desired product and can render such products unacceptable as food supplements. Animal oils and, in particular, fish oils, can accumulate environmental pollutants. Weather and disease can cause fluctuation in yields from both fish and plant sources.

An expansive supply of ARA from fish and from chemical synthesis are not sufficient for commercial needs. Therefore, it is of interest to find alternative means to allow production of commercial quantities of ARA. Biotechnology using an oilseed plant offers an attractive route for producing ARA in a safe and cost efficient manner.

Applicants' Assignee's co-pending application include the following: (1) PCT Publication No. WO 04/071467 (published Aug. 26, 2004) concerns the production of PUFAs in plants; (2) PCT Publication No. WO 04/071178 (published Aug. 26, 2004) concerns annexin promoters and their use in expression of transgenes in plants; (3) PCT Publication No. WO 05/047479 (published May 26, 2005) discloses a delta-15 desaturase from *Fusarium moniliforme*; (4) U.S. application Ser. No. 11/601,563 (filed Nov. 16, 2006, which published May 24, 2007) discloses a delta-9 elongase from *Eulgena gracilis*; (5) U.S. patent application Ser. No. 11/737,772 (filed Apr. 20, 2007) discloses a delta-8 desaturase from *Pavlova lutheri*; (6) U.S. patent application Ser. No. 11/748,629 (filed May 15, 2007, which published Dec. 20, 2007) discloses a delta-5 desaturase from *Eulgena gracilis*; and (7) U.S. patent application Ser. No. 11/876,115 (filed Oct. 22, 2007) discloses a delta-8 desaturase from *Tetruetreptia pomquetensis* CCMP1491.

SUMMARY OF THE INVENTION

In a first embodiment, the present invention concerns a transgenic oilseed plant that produces mature seeds in which the total seed fatty acid profile comprises at least 10.0% arachidonic acid and less than 5% total omega-3 fatty acids having at least eighteen carbon atoms and at least four double bonds.

In a second embodiment, the present invention concerns a transgenic oilseed plant that produces mature seeds in which the total seed fatty acid profile comprises at least 10.0% arachidonic acid and less than 1% total omega-3 fatty acids having at least eighteen carbon atoms and at least four double bonds.

In a third embodiment, the present invention concerns a transgenic oilseed plant that produces mature seeds in which the total seed fatty acid profile comprises at least 10.0% arachidonic acid and less than 5% gamma-linolenic acid.

In a fourth embodiment, the present invention concerns a transgenic oilseed plant that produces mature seeds in which the total seed fatty acid profile comprises at least 10.0% arachidonic acid and less than or equal to 1% gamma-linolenic acid.

In a fifth embodiment, the present invention concerns a transgenic oilseed plant that produces mature seeds in which the total seed fatty acid profile comprises at least 10.0% arachidonic acid and less than or equal to 1% gamma-linolenic acid and less than 1% total omega-3 fatty acids having at least eighteen carbon atoms and at least four double bonds.

The present invention also concerns seeds obtained from such transgenic oilseed plants as well as oil obtained from these seeds. Oilseed plants which can be transformed can be selected from the group consisting of soybean, *Brassica* species, sunflower, maize, cotton, flax, and safflower.

Oils of the invention can be incorporated into a food product or food analog, a medical food or medical food analog, a pharmaceutical product, a beverage, infant formula, a nutritional supplement, a pet food, animal feed or aquafeed.

Food products incorporating such oils can be selected from the group consisting of a spray-dried food particle, a freeze-dried food particle, meat products, a cereal food, a snack food, a baked good, an extruded food, a fried food, a health food, a dairy food, meat analogs, cheese analogs, milk analogs, a pet food, animal feed or aquaculture feed.

Seeds obtained from such transgenic oilseed plant can be incorporated into a pet food, aquafeed and/or animal feed.

Also of interest are whole seed products made from seeds of the invention, blended oil products comprising an oil of the invention, products made from the hydrogenation, fractionation, interesterification or hydrolysis of an oil of the invention, by-product(s) made during the production of an oil of the invention and partially processed by-products made during the production of an oil of the invention.

Biological Deposits

The following plasmid has been deposited with the American Type Culture Collection (ATCC), 10801 University Boulevard, Manassas, Va. 20110-2209, and bears the following designation, Accession Number and date of deposit (Table 1).

TABLE 1

ATCC Deposit

| Plasmid | Accession Number | Date of Deposit |
| --- | --- | --- |
| pKR72 | PTA-6019 | May 28, 2004 |
| pKR275 | PTA-4989 | Jan. 30, 2003 |
| pKKE2 | PTA-4987 | Jan. 30, 2003 |

BRIEF DESCRIPTION OF THE DRAWINGS AND SEQUENCE LISTING

The invention can be more fully understood from the following detailed description and the accompanying drawings and Sequence Listing, which form a part of this application.

FIG. 12 shows construct combinations for generating arachidonic acid (ARA) in soybean.

FIG. 17 shows the fatty acid profiles for embryos from event 4838-4-18 which has the highest levels of arachidonic acid (see Example 13).

Figure 1:
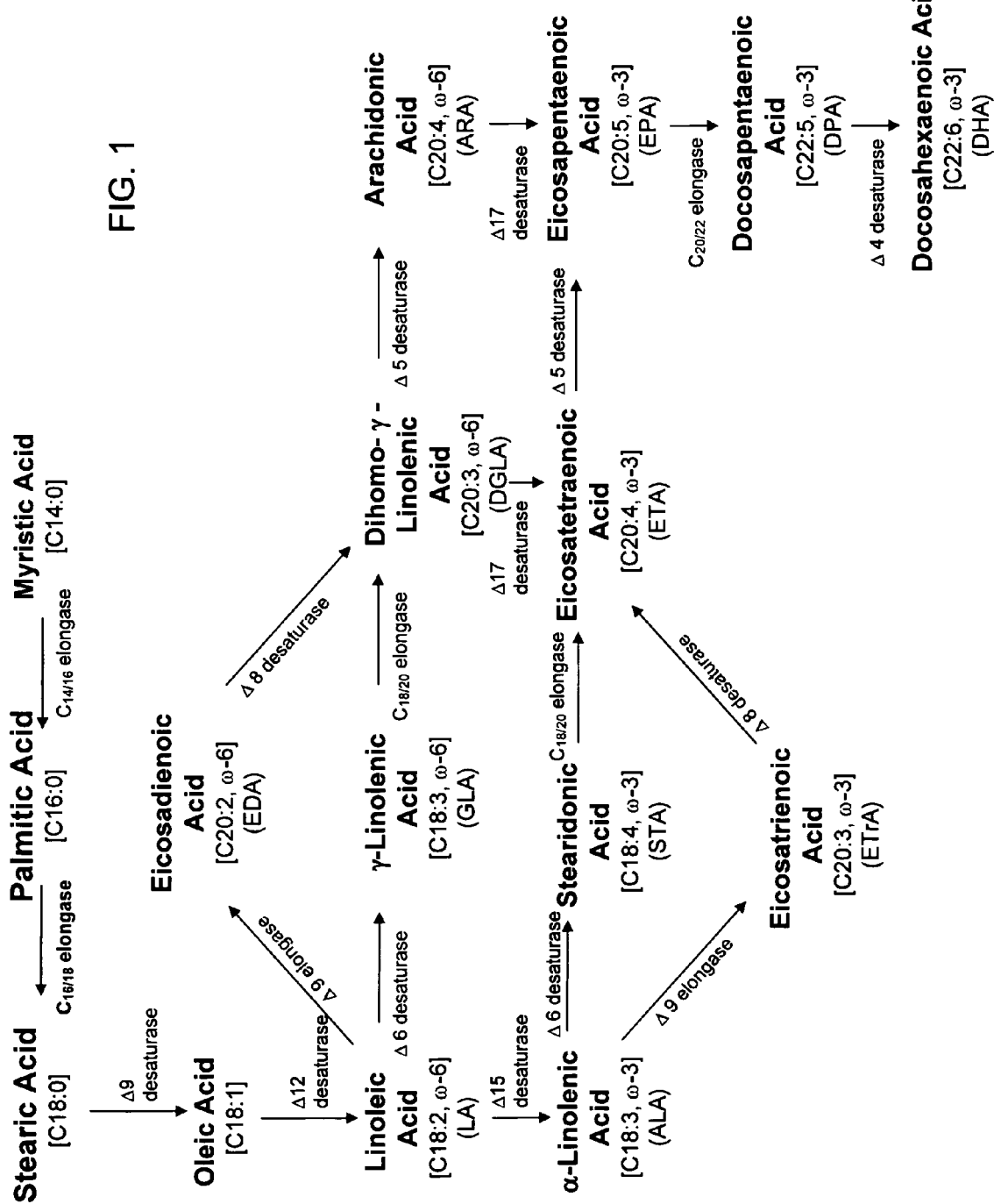
FIG. 1 is a representative omega-3 and omega-6 fatty acid pathway providing for the conversion of myristic acid through various intermediates to docosahexaenoic acid.

FIG. 26 shows the fatty acid profiles for five events having the lowest average ALA content (average of the 5 soybean somatic embryos analyzed) along with an event (2148-3-8-1) having a fatty acid profile typical of wild type embryos for this experiment. Fatty acids are identified as 16:0 (palmitate), 18:0 (stearic acid), 18:1 (oleic acid), LA, and ALA. Fatty acid compositions are expressed as a weight percent (wt. %) of total fatty acids.

FIG. 27 shows the fatty acid profiles for five events having the highest average DGLA content (average of 5 soybean somatic embryos analyzed). Fatty acids are identified as 16:0 (palmitate), 18:0 (stearic acid), 18:1 (oleic acid), LA, ALA, EDA, ERA, DGLA and ETA. Fatty acid compositions are expressed as a weight percent (wt. %) of total fatty acids.

FIG. 28 shows the average fatty acid profiles (Average of 10 soybean somatic embryos) for 20 events having the highest ARA. Fatty acids are identified as 16:0 (palmitate), 18:0 (stearic acid), 18:1 (oleic acid), LA, ALA, EDA, SCI, DGLA, ARA, ERA, JUN, ETA and EPA. Fatty acid compositions are expressed as a weight percent (wt. %) of total fatty acids. Fatty acids listed as "others" include: 18:2 (5,9), 18:3 (5,9,12), STA, 20:0, 20:1(11), 20:2 (7,11) or 20:2 (8,11) and DPA.

FIG. 29 shows the actual fatty acid profiles for each soybean somatic embryo from one event (AFS 5416-8-1-1) having an average ARA content of 17.0% and average EPA content of 1.5%. Fatty acids are identified as 16:0 (palmitate), 18:0 (stearic acid), 18:1 (oleic acid), LA, ALA, EDA, SCI, DGLA, ARA, ERA, JUN, ETA and EPA; Fatty acid compositions are expressed as a weight percent (wt. %) of total fatty acids. Fatty acids listed as "others" include: 18:2 (5,9), 18:3 (5,9,12), STA, 20:0, 20:1(11), 20:2 (7,11) or 20:2 (8,11) and DPA.

FIG. 30 shows the average fatty acid profiles (Average of 9 or 10 soybean somatic embryos) for 20 events having the highest ARA. Fatty acids are identified as 16:0 (palmitate), 18:0 (stearic acid), 18:1 (oleic acid), LA, ALA, EDA, SCI, DGLA, ARA, ERA, JUN, ETA and EPA; Fatty acid compositions are expressed as a weight percent (wt. %) of total fatty acids. Fatty acids listed as "others" include: 18:2 (5,9), 18:3 (5,9,12), STA, 20:0, 20:1(11), 20:2 (7,11) or 20:2 (8,11) and DPA.

FIG. 31 shows the lipid profiles of T2 bulk *Arabidopsis* seed for the 19 transformed events. Fatty acids are identified as 16:0 (palmitate), 18:0 (stearic acid), 18:1 (oleic acid), LA, ALA, 20:1 (eicosenoic acid), EDA, DGLA, ERA ETA and EPA. Fatty acid compositions are expressed as a weight percent (wt. %) of total fatty acids. Fatty acids listed as "others" include: 18:2 (5,9), 18:3 (5,9,12), STA, 20:0 (arachidic acid), 20:2 (7,11) or 20:2 (8,11), SCI and JUP.

FIG. 32. shows the lipid profiles of individual T2 *Arabidopsis* seeds transformed with pKR1193 for expression of a *Euglena anabaena* delta-9 elongase with a *Euglena anabaena* delta-8 desaturase and a *Euglena anabaena* delta-5 desaturase in *Arabidopsis* are shown in FIG. 32. Fatty acids are identified as 16:0 (palmitate), 18:0 (stearic acid), 18:1 (oleic acid), LA, GLA, ALA, STA, 20:1 (eicosenoic acid), EDA, DGLA, ERA, ETA and EPA and DPA; and, fatty acid compositions listed in FIG. 32 are expressed as a weight percent (wt. %) of total fatty acids. For FIG. 32, fatty acids listed as "others" include: 18:3 (5,9,12), 20:0 (arachidic acid), 20:2 (7,11) or 20:2 (8,11) & 22:0.

The sequence descriptions summarize the Sequences Listing attached hereto. The Sequence Listing contains one letter codes for nucleotide sequence characters and the single and three letter codes for amino acids as defined in the IUPAC-IUB standards described in *Nucleic Acids Research* 13:3021-3030 (1985) and in the *Biochemical Journal* 219(2):345-373 (1984).

SEQ ID NO:1 is the nucleotide sequence of KS129.
SEQ ID NO:2 is the nucleotide sequence of PKR457.
SEQ ID NO:3 is the nucleotide sequence of pKR606.
SEQ ID NO:4 is the nucleotide sequence of pKR277.
SEQ ID NO:5 is the nucleotide sequence of pKR804.
SEQ ID NO:6 is the nucleotide sequence of pKR953.
SEQ ID NO:7 is the nucleotide sequence of pKR1084.
SEQ ID NO:8 is the nucleotide sequence of pKR1002.
SEQ ID NO:9 is the nucleotide sequence of pKR226.
SEQ ID NO:10 is the nucleotide sequence of BC-Tpom_ALS.
SEQ ID NO:11 is the nucleotide sequence of BC-Tpom_ALSrev.
SEQ ID NO:12 is the nucleotide sequence of pKR132.
SEQ ID NO:13 is the nucleotide sequence of oligonucleotide EgD5-5Not.
SEQ ID NO:14 is the nucleotide sequence of oligonucleotide EgD5-3Not.
SEQ ID NO:15 is the nucleotide sequence of pKR268.
SEQ ID NO:16 is the nucleotide sequence of Ann-EgD5.
SEQ ID NO:17 is the nucleotide sequence of BC-Tpom_Ann-EgD5_ALS.
SEQ ID NO:18 is the nucleotide sequence of BC-Tpom_Ann-EgD5_ALSrev.
SEQ ID NO:19 is the nucleotide sequence of KS133.
SEQ ID NO:20 is the nucleotide sequence of KS263.
SEQ ID NO:21 is the nucleotide sequence of ELfad3-5Not.
SEQ ID NO:22 is the nucleotide sequence of ELfad3-3Not.
SEQ ID NO:23 is the nucleotide sequence of ELVIS-LIVES/fad3 cassette ELfad3Not.
SEQ ID NO:24 is the nucleotide sequence of pKR179.
SEQ ID NO:25 is the nucleotide sequence of BC-ELfad3.
SEQ ID NO:26 is the nucleotide sequence of BC-Tpom_Ann-HPfad3ABA'_ALS.
SEQ ID NO:27 is the nucleotide sequence of BC-ELfad3_ALS.
SEQ ID NO:28 is the nucleotide sequence of Ann-ELfad3.
SEQ ID NO:29 is the nucleotide sequence of BC-Tpom_Ann-ELfad3_ALS.
SEQ ID NO:30 is the nucleotide sequence of HPfad3-1.
SEQ ID NO:31 is the nucleotide sequence of HPfad3-2.
SEQ ID NO:32 is the nucleotide sequence of HPfad3AB.
SEQ ID NO:33 is the nucleotide sequence of HPfad3-3.
SEQ ID NO:34 is the nucleotide sequence of HPfad3-4.
SEQ ID NO:35 is the nucleotide sequence of HPfad3A'.
SEQ ID NO:36 is the nucleotide sequence of HPfad3ABA'.
SEQ ID NO:37 is the nucleotide sequence of BC-HPfad3ABA'.
SEQ ID NO:38 is the nucleotide sequence of Ann-HPfad3ABA'.
SEQ ID NO:39 is the nucleotide sequence of HPfad3ABA'_ALS.
SEQ ID NO:40 is the nucleotide sequence of pKKE2.
SEQ ID NO:41 is the nucleotide sequence of pKR973.
SEQ ID NO:42 is the nucleotide sequence of the oligonucleotide primer oEugEL1-1.
SEQ ID NO:43 is the nucleotide sequence of the oligonucleotide primer oEugEL1-2.
SEQ ID NO:44 is the nucleotide sequence of pKR1005.
SEQ ID NO:45 is the nucleotide sequence of pKR906.

TABLE 2

Summary of Nucleic Acid and Amino Acid Sequnces of Various PUFA Biosynthetic Pathway Genes

| Organism and Gene | Abbreviation | Nucleic Acid SEQ ID NO: and Amino Acid SEQ ID NO: |
|---|---|---|
| *Euglena gracilis* delta-9 elongase | EgD9elo | SEQ ID NO: 46<br>SEQ ID NO: 47 |
| *Pavlova lutheri* delta-8 desaturase | PavD8 | SEQ ID NO: 48<br>SEQ ID NO: 49 |
| *Tetruetreptia pomquetensis* CCMP1491 delta-8 desaturase | TpomD8 | SEQ ID NO: 50<br>SEQ ID NO: 51 |
| *Mortierella alpina* delta-5 desaturase | MaD5 | SEQ ID NO: 52<br>SEQ ID NO: 53 |
| *Euglena gracilis* delta-5 desaturase | EgD5 | SEQ ID NO: 54<br>SEQ ID NO: 55 |
| *Saprolegnia diclina* delta-17 desaturase | SdD17 | SEQ ID NO: 56<br>SEQ ID NO: 57 |
| *Fusarium moniliforme* delta-15 desaturase | FmD15 | SEQ ID NO: 58<br>SEQ ID NO: 59 |

SEQ ID NO:60 is the nucleotide sequence of the SMART IV oligonucleotide.
SEQ ID NO:61 is the nucleotide sequence of the adaptor primer from Invitrogen 3'-RACE kit.
SEQ ID NO:62 is the nucleotide sequence of the TpomNot-5.
SEQ ID NO:63 is the nucleotide sequence of the TpomNot-3.
SEQ ID NO:64 is the nucleotide sequence of pLF114-10.
SEQ ID NO:65 is the nucleotide sequence of pKR271.
SEQ ID NO:66 is the nucleotide sequence of pKR886r.
SEQ ID NO:67 is the nucleotide sequence of pKR72.
SEQ ID NO:68 is the nucleotide sequence of oCon-1.
SEQ ID NO:69 is the nucleotide sequence of oCon-2.
SEQ ID NO:70 is the nucleotide sequence of the modified Kti/NotI/Kti3'Salb3' cassette.
SEQ ID NO:71 is the nucleotide sequence of pKR970.
SEQ ID NO:72 is the nucleotide sequence of PvDES5'Not-1.
SEQ ID NO:73 is the nucleotide sequence of PvDES3'Not-1.
SEQ ID NO:74 is the nucleotide sequence of pLF113.
SEQ ID NO:75 is the nucleotide sequence of pKR287.
SEQ ID NO:76 is the nucleotide sequence of pKR1155.
SEQ ID NO:77 is the nucleotide sequence of pKR952.
SEQ ID NO:78 is the nucleotide sequence of primer M13F.
SEQ ID NO:79 is the amino acid sequence of the *Pavlova* sp. CCMP459 C20-PUFA Elongase (NCBI Accession No. AAV33630 (GI 54307108; CDS AY630573)
SEQ ID NO:80 is the nucleotide sequence of the 5' end of the cDNA insert of eeg1c.pk016.e6.f.
SEQ ID NO:81 is the nucleotide sequence of eeg1c.pk016.e6.f.
SEQ ID NO:82 is the nucleotide sequence of the codon region of eeg1c.pk016.e6.f.
SEQ ID NO:83 is the deduced amino acid sequence of SEQ ID NO:82 also referred to as the amino acid sequence of the *Euglena gracilis* DHA synthase 1 (EgDHAsyn1))
SEQ ID NO:84 is the amino acid sequence of the delta-4 fatty acid desaturase from *Euglena gracilis*
SEQ ID NO:85 is the amino acid sequence of the C20PUFA elongase 2 from *Ostreococcus tauri*.
SEQ ID NO:86 is the amino acid sequence of the C20PUFA elongase 2 from *Thalassiosira pseudonana*.

SEQ ID NO:87 is the nucleotide sequence of the delta-4 desaturase from *Thraustochytrium aureum*.

SEQ ID NO:88 is the amino acid sequence of the delta-4 desaturase from *Schizochytrium aggregatum*.

SEQ ID NO:89 is the amino acid sequence of the delta-4 desaturase from *Thalassiosira pseudonana*.

SEQ ID NO:90 is the amino acid sequence of the delta-4 desaturase from *Isochrysis galbana*

SEQ ID NO:91 is the nucleotide sequence of the EgDHAsyn1 C20 elongase domain.

SEQ ID NO:92 is the amino acid sequence of the EgDHAsyn1 C20 elongase domain (EgDHAsyn1C20Elo1)

SEQ ID NO:93 is the amino acid sequence of the KNGK NG-motif.

SEQ ID NO:94 is the amino acid sequence of the PENGA NG-motif.

SEQ ID NO:95 is the amino acid sequence of the PENGA NG-motif.

SEQ ID NO:96 is the amino acid sequence of the PCENGTV NG-motif.

SEQ ID NO:97 is the nucleotide sequence of the EgDHAsyn1 proline-rich linker.

SEQ ID NO:98 is the amino acid sequence of the EgDHAsyn1 proline-rich linker.

SEQ ID NO:99 is the nucleotide sequence pLF121-1.

SEQ ID NO:100 is the nucleotide sequence pLF121-2.

SEQ ID NO:101 is the nucleotide sequence of the codon region of EaD9Elo1.

SEQ ID NO:102 is the nucleotide sequence of the codon region of EaD9Elo2.

SEQ ID NO:103 is the amino acid sequence of EaD9Elo1.

SEQ ID NO:104 is the amino acid sequence of EaD9Elo2.

SEQ ID NO:105 is the nucleotide sequence of pLF119.

SEQ ID NO:104 is the nucleotide sequence of the codon region of EaD5Des1.

SEQ ID NO:107 is the amino acid sequence of EaD5Des1.

SEQ ID NO:108 is the nucleotide sequence of EaD9-5Bbs.

SEQ ID NO:109 is the nucleotide sequence of EaD9-3fusion.

SEQ ID NO:110 is the nucleotide sequence of EgDHAsyn1Link-5fusion.

SEQ ID NO:111 is the nucleotide sequence of MWG511.

SEQ ID NO:112 is the nucleotide sequence of EgD9elo-EgDHAsyn1Link.

SEQ ID NO:113 is the nucleotide sequence of pLF124.

SEQ ID NO:114 is the nucleotide sequence of KS366.

SEQ ID NO:115 is the nucleotide sequence of pKR1177.

SEQ ID NO:116 is the nucleotide sequence of pKR1179.

SEQ ID NO:117 is the nucleotide sequence of pKR1183.

SEQ ID NO:118 is the nucleotide sequence of pKR1237.

SEQ ID NO:119 is the nucleotide sequence of pKR1252.

SEQ ID NO:120 is the nucleotide sequence of pKR1253.

SEQ ID NO:121 is the nucleotide sequence of oligonucleotide oEAd5-1-1.

SEQ ID NO:122 is the nucleotide sequence of oligonucleotide oEAd5-1-2.

SEQ ID NO:123 is the nucleotide sequence of pKR1136.

SEQ ID NO:124 is the nucleotide sequence of pKR1139.

SEQ ID NO:125 is the nucleotide sequence of pKR561.

SEQ ID NO:126 is the nucleotide sequence of oligonucleotide HPfad3A'-2.

SEQ ID NO:127 is the nucleotide sequence of oligonucleotide HPfad3ABA'-2.

SEQ ID NO:128 is the nucleotide sequence of pLF129.

SEQ ID NO:129 is the nucleotide sequence of pKR1189.

SEQ ID NO:130 is the nucleotide sequence of pKR1209.

SEQ ID NO:131 fad3c CDS.

SEQ ID NO:132 is the amino acid sequence of fad3c.

SEQ ID NO:133 is the nucleotide sequence of oligonucleotide fad3c-5.

SEQ ID NO:134 is the nucleotide sequence of oligonucleotide fad3c-3.

SEQ ID NO:135 is the nucleotide sequence of pKR1213.

SEQ ID NO:136 is the nucleotide sequence of pKR1218.

SEQ ID NO:137 is the nucleotide sequence of pKR1210.

SEQ ID NO:138 is the nucleotide sequence of pKR1219.

SEQ ID NO:139 is the nucleotide sequence of pKR1225.

SEQ ID NO:140 is the nucleotide sequence of pKR1229.

SEQ ID NO:141 is the nucleotide sequence of pKR1249.

SEQ ID NO:142 is the nucleotide sequence of *Euglena gracilis* delta-8 desaturase CDS (Eg5).

SEQ ID NO:143 is the nucleotide sequence of the vector-specific primer pDonor222Eg5-1.

SEQ ID NO:144 is the nucleotide sequence of D8DEG3-1.

SEQ ID NO:145 is the nucleotide sequence of D8DEG3-2.

SEQ ID NO:146 is the nucleotide sequence of D8DEG3-3.

SEQ ID NO:147 is the nucleotide sequence of D8DEG3-4.

SEQ ID NO:148 is the nucleotide sequence of pHD23-1.

SEQ ID NO:149 is the amino acid sequence of *Euglena gracilis* delta-8 desaturase (NCBI Accession No. AAD45877).

SEQ ID NO:150 is the nucleotide sequence of pLF118-3.

SEQ ID NO:151 is the nucleotide sequence of the codon region of EaD8Des3.

SEQ ID NO:152 is the amino acid sequence of EaD8Des3.

SEQ ID NO:153 is the nucleotide sequence of oligonucleotide EaD8-5.

SEQ ID NO:154 is the nucleotide sequence of oligonucleotide EaD8-3.

SEQ ID NO:155 is the nucleotide sequence of pLF120-3.

SEQ ID NO:156 is the nucleotide sequence of oEAd9el1-1.

SEQ ID NO:157 is the nucleotide sequence of oEAd9el1-2.

SEQ ID NO:158 is the nucleotide sequence of pKR1137.

SEQ ID NO:159 is the nucleotide sequence of pKR1140.

SEQ ID NO:160 is the nucleotide sequence of pKR1173.

SEQ ID NO:161 is the nucleotide sequence of pKR393.

SEQ ID NO:162 is the nucleotide sequence of pKR407.

SEQ ID NO:163 is the nucleotide sequence of pKR1176.

SEQ ID NO:164 is the nucleotide sequence of pKR1178.

SEQ ID NO:165 is the nucleotide sequence of oligo oKti5.

SEQ ID NO:166 is the nucleotide sequence of oligo oKti6.

SEQ ID NO:167 is the nucleotide sequence of pKR193.

SEQ ID NO:168 is the nucleotide sequence of pKR1174.

SEQ ID NO:169 is the nucleotide sequence of pKR1186.

SEQ ID NO:170 is the nucleotide sequence of pKR1193.

SEQ ID NO:171 is the sequence of the SeqE primer.

SEQ ID NO:172 is the sequence of the SeqW primer.

DETAILED DESCRIPTION OF THE INVENTION

The disclosure of each reference set forth herein is hereby incorporated by reference in its entirety.

As used herein and in the appended claims, the singular forms "a", "an", and "the" include plural reference unless the context clearly dictates otherwise. Thus, for example, reference to "a plant" includes a plurality of such plants, reference to "a cell" includes one or more cells and equivalents thereof known to those skilled in the art, and so forth.

In the context of this disclosure, a number of terms and abbreviations are used. The following definitions are provided.

The term "EgD9elo" refers to a delta-9 elongase isolated from *Euglena gracilis* (SEQ ID NOs:46 and 47; see also Applicants' Assignee's co-pending application having U.S. application Ser. No. 11/601,563 (filed Nov. 16, 2006, which published May 24, 2007).

The term "PavD8" refers to a delta-8 desaturase enzyme isolated from *Pavlova lutheri* (SEQ ID NOs:48 and 49; see also Applicants' Assignee's co-pending application having U.S. patent application Ser. No. 11/737,772 (filed Apr. 20, 2007).

The term "TpomD8" refers to a delta-8 desaturase enzyme isolated from *Tetruetreptia pomquetensis* CCMP1491 (SEQ ID NOs:50 and 51; see also Applicants' Assignee's co-pending application having U.S. patent application Ser. No. 11/876,115 (filed Oct. 22, 2007).

The term "MaD5" refers to a delta-5 desaturase enzyme isolated from *Mortierella alpina* (SEQ ID NOs:52 and 53; see also GenBank Accession No. AF067654 and U.S. Pat. No. 6,075,183).

The term "EgD5" refers to a delta-5 desaturase enzyme isolated from *Euglena gracilis* (SEQ ID NOs:54 and 55; see also Applicants' Assignee's co-pending application having U.S. patent application Ser. No. 11/748,629 (filed May 15, 2007, which published Dec. 20, 2007).

The term "SdD17" refers to a delta-17 desaturase enzyme isolated from *Saprolegnia diclina* (SEQ ID NOs:56 and 57).

The term "FmD15" refers to a delta-15 desaturase enzyme isolated from *Fusarium moniliforme* (SEQ ID NOs:58 and 59; see also Applicants' Assignee's co-pending application having PCT Publication No. WO 05/047479 (published May 26, 2005).

"Open reading frame" is abbreviated ORF.

"Polymerase chain reaction" is abbreviated PCR.

"American Type Culture Collection" is abbreviated ATCC.

"Polyunsaturated fatty acid(s)" is abbreviated PUFA(s).

"Triacylglycerols" are abbreviated TAGs.

The term "fatty acids" refers to long-chain aliphatic acids (alkanoic acids) of varying chain lengths, from about $C_{12}$ to $C_{22}$ (although both longer and shorter chain-length acids are known). The predominant chain lengths are between $C_{16}$ and $C_{22}$. Additional details concerning the differentiation between "saturated fatty acids" versus "unsaturated fatty acids", "monounsaturated fatty acids" versus "polyunsaturated fatty acids" (or "PUFAs"), and "omega-6 fatty acids" (n-6 or n-6) versus "omega-3 fatty acids" (n-3 or n-3) are provided in PCT Publication No. WO 04/101757.

Omega-3 fatty acids are a family of polyunsaturated fatty acids which have in common a carbon-carbon double bond in the omega-3 position. The term omega-3 ("n-3, "ω-3) signifies that the first double bond exists as the third carbon-carbon bond from the terminal methyl end (omega) of the carbon chain. Important omega-3 fatty acids in nutrition are the following: alpha-linlenic acid (ALA), eicosapentaenoic acid (EPA) and docosahexaenoic acid (DHA). The human body cannot synthesize omega-3 fatty acids de novo, but can synthesize all the other necessary omega-3 fatty acids from the simpler omega-3 fatty acid ALA. Therefore, ALA is an essential nutrient which must be obtained from food, and the other omega-3 fatty acids which can be either synthesized from it within the body or obtained from food are sometimes also referred to as essential nutrients. Table 3 below lists omega-3 fatty acids.

TABLE 3

Omega-3 Fatty Acids

| Common Name | Lipid Name | Chemical Name |
|---|---|---|
| α-linolenic acid (ALA) | 18:3 (n-3) | octadeca-9,12,15-trienoic acid |
| stearidonic acid | 18:4 (n-3) | octadeca-6,9,12,15-tetraenoic acid |
| eicosatetraenoic acid | 20:4 (n-3) | eicosa-8,11,14,17-tetraenoic acid |
| eicosapentaenoic acid (EPA) | 20:5 (n-3) | eicosa-5,8,11,14,17-pentaenoic acid |
| docosapentaenoic acid | 22:5 (n-3) | docosa-7,10,13,16,19-pentaenoic acid |
| docosahexaenoic acid (DHA) | 22:6 (n-3) | docosa-4,7,10,13,16,19-hexaenoic acid |

Omega-6 fatty acids are fatty acids where the term "omega-6" signifies that the first double bond in the carbon backbone of the fatty acid, occurs in the omega minus 6 position; that is, the sixth carbon from the end of the fatty acid. Linoleic acid (18:2), the shortest chain omega-6 fatty acid is an essential fatty acid. Arachidonic acid (20:4) is a physiologically significant n-6 fatty acid and is the precursor for prostaglandins and other physiologically active molecules. Table 4 sets forth omega-6 fatty acids.

TABLE 4

Omega-6 Fatty Acids

| Common Name | Lipid Name | Chemical Name |
|---|---|---|
| linoleic acid | 18:2 (n-6) | 9,12-octadecadienoic acid |
| gamma-linolenic acid (GLA) | 18:3 (n-6) | 6,9,12-octadecatrienoic acid |
| eicosadienoic acid | 20:2 (n-6) | 11,14-eicosadienoic acid |
| dihomo-gamma-linolenic acid | 20:3 (n-6) | 8,11,14-eicosatrienoic acid |
| arachidonic acid (ARA) | 20:4 (n-6) | 5,8,11,14-eicosatetraenoic acid |
| docosadienoic acid | 22:2 (n-6) | 13,16-docosadienoic acid |
| adrenic acid | 22:4 (n-6) | 7,10,13,16-docosatetraenoic acid |
| docosapentaenoic acid | 22:5 (n-6) | 4,7,10,13,16-docosapentaenoic acid |

Fatty acids are described herein by a simple notation system of "X:Y", wherein X is number of carbon (C) atoms in the particular fatty acid and Y is the number of double bonds. The number following the fatty acid designation indicates the position of the double bond from the carboxyl end of the fatty acid with the "c" affix for the cis-configuration of the double bond (e.g., palmitic acid (16:0), stearic acid (18:0), oleic acid (18:1, 9c), petroselinic acid (18:1, 6c), LA (18:2, 9c,12c), GLA (18:3, 6c,9c,12c) and ALA (18:3, 9c,12c,15c)). Unless otherwise specified, 18:1, 18:2 and 18:3 refer to oleic, LA and ALA fatty acids, respectively. If not specifically written as otherwise, double bonds are assumed to be of the cis configuration. For instance, the double bonds in 18:2 (9,12) would be assumed to be in the cis configuration.

Nomenclature used to describe PUFAs in the present disclosure is shown below in Table 5. In the column titled "Shorthand Notation", the omega-reference system is used to indicate the number of carbons, the number of double bonds and the position of the double bond closest to the omega carbon, counting from the omega carbon (which is numbered 1 for this purpose). The remainder of the table summarizes the common names of omega-3 and omega-6 fatty acids and their precursors, the abbreviations that will be used throughout the remainder of the specification, and each compounds' chemical name.

TABLE 5

Nomenclature of Polyunsaturated Fatty Acids and Precursors

| Common Name | Abbreviation | Chemical Name | Shorthand Notation |
|---|---|---|---|
| myristic | — | tetradecanoic | 14:0 |
| palmitic | PA | hexadecanoic | 16:0 |
| palmitoleic | — | 9-hexadecenoic | 16:1 |
| stearic | — | octadecanoic | 18:0 |
| oleic | — | cis-9-octadecenoic | 18:1 |
| linoleic | LA | cis-9,12-octadecadienoic | 18:2 ω-6 |
| gamma-linolenic | GLA | cis-6,9,12-octadecatrienoic | 18:3 ω-6 |
| eicosadienoic | EDA | cis-11,14-eicosadienoic | 20:2 ω-6 |
| dihomo-gamma-linolenic | DGLA or HGLA | cis-8,11,14-eicosatrienoic | 20:3 ω-6 |
| sciadonic | SCI | cis-5,11,14-eicosatrienoic | 20:3b ω-6 |
| arachidonic | ARA | cis-5,8,11,14-eicosatetraenoic | 20:4 ω-6 |
| alpha-linolenic | ALA | cis-9,12,15-octadecatrienoic | 18:3 ω-3 |
| stearidonic | STA | cis-6,9,12,15-octadecatetraenoic | 18:4 ω-3 |
| eicosatrienoic | ETrA or ERA | cis-11,14,17-eicosatrienoic | 20:3 ω-3 |
| eicosatetraenoic | ETA | cis-8,11,14,17-eicosatetraenoic | 20:4 ω-3 |
| juniperonic | JUP or JUN | cis-5,11,14,17-eicosatrienoic | 20:4b ω-3 |
| eicosapentaenoic | EPA | cis-5,8,11,14,17-eicosapentaenoic | 20:5 ω-3 |
| docosapentaenoic | DPA | cis-7,10,13,16,19-docosapentaenoic | 22:5 ω-3 |
| docosahexaenoic | DHA | cis-4,7,10,13,16,19-docosahexaenoic | 22:6 ω-3 |

The term "arachidonic acid" ("ARA") refers to an omega-6 fatty acid having the chemical formula $C_{20}H_{32}O_2$. It is also given the name 20:4 (n-6). Its systematic chemical name is set forth above in Table 5. It is an essential dietary component for mammals. The free acid is the precursor for biosynthesis of prostaglandins, thromboxanes, hydroxyeicosatetraenoic acid derivatives including leucotrienes. Within cells the acid is found in the esterified form as a major acyl component of membrane phospholipids. Little or no ARA is found in plants. The term ARA as used herein encompasses both the free acid and derivatives thereof, e.g., its esterified form.

The term "high-level ARA production" refers to a transgenic oilseed plant that produces mature seeds in which the total seed fatty acid profile comprises at least 10% ARA, or at least 15% ARA, or at least 20% ARA, or at least 25% ARA. The structural form of the ARA is not limiting; thus, for example, the ARA may exist in the seed fatty acid profile as free fatty acids or in esterified forms such as acylglycerols, phospholipids, sulfolipids or glycolipids.

The term "reduced content of omega-3 fatty acids" refers to a transgenic oilseed plant that produces mature seeds in which the total seed fatty acid profile comprises less than 5% total omega-3 fatty acids, or more preferably less than 1% total omega-3 fatty acids, or any integer % between 5% and 1% such 4%, 3% and 2%.

The term "reduced content of GLA" refers to a transgenic oilseed plant that produces mature seeds in which the total seed fatty acid profile comprises less than 5% total GLA, or more preferably less than or equal to 1% total GLA, or any integer % between 5% and 1% such 4%, 3% and 2%, A metabolic pathway, or biosynthetic pathway, in a biochemical sense, can be regarded as a series of chemical reactions occurring within a cell, catalyzed by enzymes, to achieve either the formation of a metabolic product to be used or stored by the cell, or the initiation of another metabolic pathway (then called a flux generating step). Many of these pathways are elaborate, and involve a step by step modification of the initial substance to shape it into a product having the exact chemical structure desired.

The term "PUFA biosynthetic pathway" refers to a metabolic process that converts oleic acid to LA, EDA, GLA, DGLA, ARA, ALA, STA, ETrA, ETA, EPA, DPA and DHA. This process is well described in the literature (e.g., see PCT Publication No. WO 06/052870). Simplistically, this process involves elongation of the carbon chain through the addition of carbon atoms and desaturation of the molecule through the addition of double bonds, via a series of special desaturation and elongation enzymes (i.e., "PUFA biosynthetic pathway enzymes") present in the endoplasmic reticulim membrane. More specifically, "PUFA biosynthetic pathway enzyme" refers to any of the following enzymes (and genes which encode said enzymes) associated with the biosynthesis of a PUFA, including: a delta-4 desaturase, a delta-5 desaturase, a delta-6 desaturase, a delta-12 desaturase, a delta-15 desaturase, a delta-17 desaturase, a delta-9 desaturase, a delta-8 desaturase, a delta-9 elongase, a $C_{14/16}$ elongase, a $C_{16/18}$ elongase, a $C_{18/20}$ elongase and/or a $C_{20/22}$ elongase.

The term "omega-3/omega-6 fatty acid biosynthetic pathway" refers to a set of genes which, when expressed under the appropriate conditions encode enzymes that catalyze the production of either or both omega-3 and omega-6 fatty acids. Typically the genes involved in the omega-3/omega-6 fatty acid biosynthetic pathway encode PUFA biosynthetic pathway enzymes. A representative pathway is illustrated in FIG. 1, providing for the conversion of myristic acid through various intermediates to DHA, which demonstrates how both omega-3 and omega-6 fatty acids may be produced from a common source. The pathway is naturally divided into two portions where one portion will generate omega-3 fatty acids and the other portion, omega-6 fatty acids.

The term "functional" as used herein in context with the omega-3/omega-6 fatty acid biosynthetic pathway means that some (or all of) the genes in the pathway express active enzymes, resulting in in vivo catalysis or substrate conversion. It should be understood that "omega-3/omega-6 fatty acid biosynthetic pathway" or "functional omega-3/omega-6 fatty acid biosynthetic pathway" does not imply that all the PUFA biosynthetic pathway enzyme genes are required, as a number of fatty acid products will only require the expression of a subset of the genes of this pathway.

The term "delta-9 elongase/delta-8 desaturase pathway" refers to a biosynthetic pathway for production of long-chain PUFAs. This pathway, at a minimum, comprises a delta-9 elongase and a delta-8 desaturase, thereby enabling biosynthesis of DGLA and/or ETA from LA and ALA, respectively. With expression of other desaturases and elongases, ARA, EPA, DPA and DHA may also be synthesized. This pathway may be advantageous in some embodiments, as the biosynthesis of GLA and/or STA is excluded.

The term "intermediate fatty acid" refers to any fatty acid produced in a fatty acid metabolic pathway that can be further converted to an intended product fatty acid in this pathway by the action of other metabolic pathway enzymes. For instance, when EPA is produced using the delta-9 elongase/delta-8 desaturase pathway, EDA, ETrA, DGLA, ETA and ARA can be produced and are considered "intermediate fatty acids" since these fatty acids can be further converted to EPA via action of other metabolic pathway enzymes.

The term "by-product fatty acid" refers to any fatty acid produced in a fatty acid metabolic pathway that is not the intended fatty acid product of the pathway nor an "intermediate fatty acid" of the pathway. For instance, when EPA is produced using the delta-9 elongase/delta-8 desaturase pathway, sciadonic acid (SCI) and juniperonic acid (JUP) also can be produced by the action of a delta-5 desaturase on either EDA or ETrA, respectively. They are considered to be "by-product fatty acids" since neither can be further converted to EPA by the action of other metabolic pathway enzymes.

The term "fad3" refers to a gene which codes for (i.e., causes production of) a delta-15 or omega-3 desaturase. Specifically, the delta-15 desaturase enzyme converts linoleic acid to alpha-linolenic acid. FAD3 and or fad3 refers to any of the three fad3 genes from soybean.

The first plant omega-3 desaturase gene identified was fad3 from *Arabidopsis* (Yadav et al., *Plant Physiol.* 103:467-476 (1993)) and at least three versions of this gene have been identified in the soybean genome, GmFAD3A (GenBank Accession No. AY204710), GmFAD3B (GenBank Accession Nos. AY204711 and L22964) and GmFAD3C (GenBank Accession No. AY204712) (Bilyeu et al., *Crop Sci.* 43:1833-1838 (2003); Anai et al., *Plant Sci.* 168:1615-1623 (2005)). Soybeans having reduced levels of ALA (low alpha-linolenic or "low lin") caused by mutations in one or more of the fad3 genes have been identified (reviewed in Bilyeu et al., *Crop Sci.* 46:1913-1918 (2006)). Mutations in GmFAD3A and GmFAD3C in soybean line CX1512-44, with ALA levels around 3% and in all three FAD3 genes, leading to soybeans with ALA levels around 1% of the total fatty acids (e.g., line A29 (Ross et al., Crop Sci. 40:383-386 (2000)) was characterized at the molecular level (see Bilyeu et al., 2006)).

The terms "down-regulate or down-regulation", as used herein, refer to a reduction or decrease in the level of expression of a gene or polynucleotide.

Down-regulation of any combination of the fad3 genes in a genetically engineered soybean plant using methods described herein, causes that soybean plant to produce mature seeds having an oil profile comprised of low-levels of linolenic acid (low-lin soybeans). On the other hand, the genome of a soybean plant could be engineered to increase expression of fad3 genes thus resulting in an oil profile wherein the level of linolenic acid constitutes about 50% of the total fatty acids in the oil obtained from such transgenic soybean plants.

The terms "triacylglycerol", "oil" and "TAGs" refer to neutral lipids composed of three fatty acyl residues esterified to a glycerol molecule (and such terms will be used interchangeably throughout the present disclosure herein). Such oils can contain long-chain PUFAs, as well as shorter saturated and unsaturated fatty acids and longer chain saturated fatty acids. Thus, "oil biosynthesis" generically refers to the synthesis of TAGs in the cell.

"Percent (%) PUFAs in the total lipid and oil fractions" refers to the percent of PUFAs relative to the total fatty acids in those fractions. The term "total lipid fraction" or "lipid fraction" both refer to the sum of all lipids (i.e., neutral and polar) within an oleaginous organism, thus including those lipids that are located in the phosphatidylcholine (PC) fraction, phosphatidyletanolamine (PE) fraction and triacylglycerol (TAG or oil) fraction. However, the terms "lipid" and "oil" will be used interchangeably throughout the specification.

The terms "conversion efficiency" and "percent substrate conversion" refer to the efficiency by which a particular enzyme (e.g., a desaturase) can convert substrate to product. The conversion efficiency is measured according to the following formula: ([product]/[substrate+product])*100, where 'product' includes the immediate product and all products in the pathway derived from it.

"Desaturase" is a polypeptide that can desaturate, i.e., introduce a double bond, in one or more fatty acids to produce a fatty acid or precursor of interest. Despite use of the omega-reference system throughout the specification to refer to specific fatty acids, it is more convenient to indicate the activity of a desaturase by counting from the carboxyl end of the substrate using the delta-system. Of particular interest herein are delta-8 desaturases that will desaturate a fatty acid between the eighth and ninth carbon atom numbered from the carboxyl-terminal end of the molecule and that can, for example, catalyze the conversion of EDA to DGLA and/or ETrA to ETA. Other useful fatty acid desaturases include, for example: (1) delta-5 desaturases that catalyze the conversion of DGLA to ARA and/or ETA to EPA; (2) delta-6 desaturases that catalyze the conversion of LA to GLA and/or ALA to STA; (3) delta-4 desaturases that catalyze the conversion of DPA to DHA; (4) delta-12 desaturases that catalyze the conversion of oleic acid to LA; (5) delta-15 desaturases that catalyze the conversion of LA to ALA and/or GLA to STA; (6) delta-17 desaturases that catalyze the conversion of ARA to EPA and/or DGLA to ETA; and (7) delta-9 desaturases that catalyze the conversion of palmitic acid to palmitoleic acid (16:1) and/or stearic acid to oleic acid (18:1). In the art, delta-15 and delta-17 desaturases are also occasionally referred to as "omega-3 desaturases", "w-3 desaturases", and/or "n-3 desaturases", based on their ability to convert omega-6 fatty acids into their omega-3 counterparts (e.g., conversion of LA into ALA and ARA into EPA, respectively). In some embodiments, it is most desirable to empirically determine the specificity of a particular fatty acid desaturase by transforming a suitable host with the gene for the fatty acid desaturase and determining its effect on the fatty acid profile of the host.

The term "elongase system" refers to a suite of four enzymes that are responsible for elongation of a fatty acid carbon chain to produce a fatty acid that is two carbons longer than the fatty acid substrate that the elongase system acts upon. More specifically, the process of elongation occurs in association with fatty acid synthase, whereby CoA is the acyl carrier (Lassner et al., *Plant Cell* 8:281-292 (1996)). In the first step, which has been found to be both substrate-specific and also rate-limiting, malonyl-CoA is condensed with a long-chain acyl-CoA to yield carbon dioxide ($CO_2$) and a □-ketoacyl-CoA (where the acyl moiety has been elongated by two carbon atoms). Subsequent reactions include reduction to □-hydroxyacyl-CoA, dehydration to an enoyl-CoA and a second reduction to yield the elongated acyl-CoA. Examples of reactions catalyzed by elongase systems are the conversion of GLA to DGLA, STA to ETA, LA to EDA, ALA to ETRA and EPA to DPA.

For the purposes herein, an enzyme catalyzing the first condensation reaction (i.e., conversion of malonyl-CoA and long-chain acyl-CvoA to □-ketoacyl-CoA) will be referred to generically as an "elongase". In general, the substrate selectivity of elongases is somewhat broad but segregated by both chain length and the degree of unsaturation. Accordingly, elongases can have different specificities. For example, a $C_{14/16}$ elongase will utilize a $C_{14}$ substrate (e.g., myristic acid), a $C_{16/18}$ elongase will utilize a $C_{16}$ substrate (e.g., palmitate), a $C_{18/20}$ elongase will utilize a $C_{18}$ substrate (e.g., GLA, STA) and a $C_{20/22}$ elongase will utilize a $C_{20}$ substrate (e.g., EPA). Similarly, a "delta-9 elongase" may be able to catalyze the conversion of LA to EDA and/or ALA to ETrA. It is important to note that some elongases have broad specificity and thus a single enzyme may be capable of catalyzing several elongase reactions. Thus, for example, a delta-9 elongase may also act as a $C_{16/18}$ elongase, $C_{18/20}$ elongase and/or $C_{20/22}$ elongase and may have alternate, but not preferred, specificities for delta-5 and delta-6 fatty acids such as EPA and/or GLA, respectively.

As used herein, "nucleic acid" means a polynucleotide and includes single or double-stranded polymer of deoxyribonucleotide or ribonucleotide bases. Nucleic acids may also include fragments and modified nucleotides. Thus, the terms "polynucleotide", "nucleic acid sequence", "nucleotide sequence" or "nucleic acid fragment" are used interchangeably and is a polymer of RNA or DNA that is single- or double-stranded, optionally containing synthetic, non-natural or altered nucleotide bases. Nucleotides (usually found in their 5'-monophosphate form) are referred to by their single letter designation as follows: "A" for adenylate or deoxyadenylate (for RNA or DNA, respectively), "C" for cytidylate or deosycytidylate, "G" for guanylate or deoxyguanylate, "U" for uridlate, "T" for deosythymidylate, "R" for purines (A or G), "Y" for pyrimidiens (C or T), "K" for G or T, "H" for A or C or T, "I" for inosine, and "N" for any nucleotide.

The terms "subfragment that is functionally equivalent" and "functionally equivalent subfragment" are used interchangeably herein. These terms refer to a portion or subsequence of an isolated nucleic acid fragment in which the ability to alter gene expression or produce a certain phenotype is retained whether or not the fragment or subfragment encodes an active enzyme. For example, the fragment or subfragment can be used in the design of chimeric genes to produce the desired phenotype in a transformed plant. Chimeric genes can be designed for use in suppression by linking a nucleic acid fragment or subfragment thereof, whether or not it encodes an active enzyme, in the sense or antisense orientation relative to a plant promoter sequence.

The term "conserved domain" or "motif" means a set of amino acids conserved at specific positions along an aligned sequence of evolutionarily related proteins. While amino acids at other positions can vary between homologous proteins, amino acids that are highly conserved at specific positions indicate amino acids that are essential in the structure, the stability, or the activity of a protein. Because they are identified by their high degree of conservation in aligned sequences of a family of protein homologues, they can be used as identifiers, or "signatures", to determine if a protein with a newly determined sequence belongs to a previously identified protein family.

The terms "homology", "homologous", "substantially similar" and "corresponding substantially" are used interchangeably herein. They refer to nucleic acid fragments wherein changes in one or more nucleotide bases do not affect the ability of the nucleic acid fragment to mediate gene expression or produce a certain phenotype. These terms also refer to modifications of the nucleic acid fragments of the instant invention such as deletion or insertion of one or more nucleotides that do not substantially alter the functional properties of the resulting nucleic acid fragment relative to the initial, unmodified fragment. It is therefore understood, as those skilled in the art will appreciate, that the invention encompasses more than the specific exemplary sequences.

Moreover, the skilled artisan recognizes that substantially similar nucleic acid sequences encompassed by this invention are also defined by their ability to hybridize (under moderately stringent conditions, e.g., 0.5×SSC, 0.1% SDS, 60° C.) with the sequences exemplified herein, or to any portion of the nucleotide sequences disclosed herein and which are functionally equivalent to any of the nucleic acid sequences disclosed herein. Stringency conditions can be adjusted to screen for moderately similar fragments, such as homologous sequences from distantly related organisms, to highly similar fragments, such as genes that duplicate functional enzymes from closely related organisms. Post-hybridization washes determine stringency conditions.

The term "selectively hybridizes" includes reference to hybridization, under stringent hybridization conditions, of a nucleic acid sequence to a specified nucleic acid target sequence to a detectably greater degree (e.g., at least 2-fold over background) than its hybridization to non-target nucleic acid sequences and to the substantial exclusion of non-target nucleic acids. Selectively hybridizing sequences typically have about at least 80% sequence identity, or 90% sequence identity, up to and including 100% sequence identity (i.e., fully complementary) with each other.

The term "stringent conditions" or "stringent hybridization conditions" includes reference to conditions under which a probe will selectively hybridize to its target sequence. Stringent conditions are sequence-dependent and will be different in different circumstances. By controlling the stringency of the hybridization and/or washing conditions, target sequences can be identified which are 100% complementary to the probe (homologous probing). Alternatively, stringency conditions can be adjusted to allow some mismatching in sequences so that lower degrees of similarity are detected (heterologous probing). Generally, a probe is less than about 1000 nucleotides in length, optionally less than 500 nucleotides in length.

Typically, stringent conditions will be those in which the salt concentration is less than about 1.5 M Na ion, typically about 0.01 to 1.0 M Na ion concentration (or other salts) at pH 7.0 to 8.3 and the temperature is at least about 30° C. for short probes (e.g., 10 to 50 nucleotides) and at least about 60° C. for long probes (e.g., greater than 50 nucleotides). Stringent conditions may also be achieved with the addition of destabilizing agents such as formamide. Exemplary low stringency conditions include hybridization with a buffer solution of 30 to 35% formamide, 1 M NaCl, 1% SDS (sodium dodecyl sulphate) at 37° C., and a wash in 1× to 2×SSC (20×SSC=3.0 M NaCl/0.3 M trisodium citrate) at 50 to 55° C. Exemplary moderate stringency conditions include hybridization in 40 to 45% formamide, 1 M NaCl, 1% SDS at 37° C., and a wash in 0.5× to 1×SSC at 55 to 60° C. Exemplary high stringency conditions include hybridization in 50% formamide, 1 M NaCl, 1% SDS at 37° C., and a wash in 0.1×SSC at 60 to 65° C.

Specificity is typically the function of post-hybridization washes, the critical factors being the ionic strength and temperature of the final wash solution. For DNA-DNA hybrids, the $T_m$ can be approximated from the equation of Meinkoth et al., *Anal. Biochem.* 138:267-284 (1984): $T_m$=81.5° C.+16.6 (log M)+0.41 (% GC)−0.61 (% form)−500/L; where M is the molarity of monovalent cations, % GC is the percentage of guanosine and cytosine nucleotides in the DNA, % form is the percentage of formamide in the hybridization solution, and L is the length of the hybrid in base pairs. The $T_m$ is the temperature (under defined ionic strength and pH) at which 50% of a complementary target sequence hybridizes to a perfectly matched probe. $T_m$ is reduced by about 1° C. for each 1% of mismatching; thus, $T_m$, hybridization and/or wash conditions can be adjusted to hybridize to sequences of the desired identity. For example, if sequences with ≧90% identity are sought, the $T_m$ can be decreased 10° C. Generally, stringent conditions are selected to be about 5° C. lower than the thermal melting point ($T_m$) for the specific sequence and its complement at a defined ionic strength and pH. However, severely stringent conditions can utilize a hybridization and/or wash at 1, 2, 3, or 4° C. lower than the thermal melting point ($T_m$); moderately stringent conditions can utilize a hybridization and/or wash at 6, 7, 8, 9, or 10° C. lower than the thermal melting point ($T_m$); low stringency conditions can utilize a hybridization and/or wash at 11, 12, 13, 14, 15, or 20° C. lower than the thermal melting point ($T_m$). Using the equation, hybridization and wash compositions, and desired $T_m$, those of ordinary skill will understand that variations in the stringency of hybridization and/or wash solutions are inherently described. If the desired degree of mismatching results in a $T_m$ of less than 45° C. (aqueous solution) or 32° C. (formamide solution) it is preferred to increase the SSC concentration so that a higher temperature can be used. An extensive guide to the hybridization of nucleic acids is found in Tijssen, *Laboratory Techniques in Biochemistry and Molecular Biology—Hybridization with Nucleic Acid Probes*, Part I, Chapter 2 "Overview of principles of hybridization and the strategy of nucleic acid probe assays", Elsevier, N.Y. (1993); and *Current Protocols in Molecular Biology*, Chapter 2, Ausubel et al., Eds., Greene Publishing and Wiley-Interscience, New York (1995). Hybridization and/or wash conditions can be applied for at least 10, 30, 60, 90, 120, or 240 minutes.

"Sequence identity" or "identity" in the context of nucleic acid or polypeptide sequences refers to the nucleic acid bases or amino acid residues in two sequences that are the same when aligned for maximum correspondence over a specified comparison window.

Thus, "percentage of sequence identity" refers to the value determined by comparing two optimally aligned sequences over a comparison window, wherein the portion of the polynucleotide or polypeptide sequence in the comparison window may comprise additions or deletions (i.e., gaps) as compared to the reference sequence (which does not comprise additions or deletions) for optimal alignment of the two sequences. The percentage is calculated by determining the number of positions at which the identical nucleic acid base or amino acid residue occurs in both sequences to yield the number of matched positions, dividing the number of matched positions by the total number of positions in the window of comparison and multiplying the results by 100 to yield the percentage of sequence identity. Useful examples of percent sequence identities include, but are not limited to, 50%, 55%, 60%, 65%, 70%, 75%, 80%, 85%, 90%, or 95%, or any integer percentage from 50% to 100%. These identities can be determined using any of the programs described herein.

Sequence alignments and percent identity or similarity calculations may be determined using a variety of comparison methods designed to detect homologous sequences including, but not limited to, the MegAlign™ program of the LASERGENE bioinformatics computing suite (DNASTAR Inc., Madison, Wis.). Within the context of this application it will be understood that where sequence analysis software is used for analysis, that the results of the analysis will be based on the "default values" of the program referenced, unless otherwise specified. As used herein "default values" will mean any set of values or parameters that originally load with the software when first initialized.

The "Clustal V method of alignment" corresponds to the alignment method labeled Clustal V (described by Higgins and Sharp, *CABIOS*. 5:151-153 (1989); Higgins, D. G. et al. (1992) *Comput. Appl. Biosci.* 8:189-191) and found in the MegAlign™ program of the LASERGENE bioinformatics computing suite (DNASTAR Inc., Madison, Wis.). For multiple alignments, the default values correspond to GAP PENALTY=10 and GAP LENGTH PENALTY=10. Default parameters for pairwise alignments and calculation of percent identity of protein sequences using the Clustal method are KTUPLE=1, GAP PENALTY=3, WINDOW=5 and DIAGONALS SAVED=5. For nucleic acids these parameters are KTUPLE=2, GAP PENALTY=5, WINDOW=4 and DIAGONALS SAVED=4. After alignment of the sequences using the Clustal V program, it is possible to obtain a "percent identity" by viewing the "sequence distances" table in the same program.

"BLASTN method of alignment" is an algorithm provided by the National Center for Biotechnology Information (NCBI) to compare nucleotide sequences using default parameters.

It is well understood by one skilled in the art that many levels of sequence identity are useful in identifying polypeptides, from other species, wherein such polypeptides have the same or similar function or activity. Useful examples of percent identities include, but are not limited to, 50%, 55%, 60%, 65%, 70%, 75%, 80%, 85%, 90%, or 95%, or any integer percentage from 50% to 100%. Indeed, any integer amino acid identity from 50% to 100% may be useful in describing the present invention, such as 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or 99%. Also, of interest is any full-length or partial complement of this isolated nucleotide fragment.

"Gene" refers to a nucleic acid fragment that expresses a specific protein, including regulatory sequences preceding (5' non-coding sequences) and following (3' non-coding sequences) the coding sequence. "Native gene" refers to a gene as found in nature with its own regulatory sequences. "Chimeric gene" refers to any gene that is not a native gene, comprising regulatory and coding sequences that are not found together in nature. Accordingly, a chimeric gene may comprise regulatory sequences and coding sequences that are derived from different sources, or regulatory sequences and coding sequences derived from the same source, but arranged in a manner different than that found in nature. A "foreign" gene refers to a gene not normally found in the host organism, but that is introduced into the host organism by gene transfer. Foreign genes can comprise native genes inserted into a non-native organism, or chimeric genes. A "transgene" is a gene that has been introduced into the genome by a transformation procedure.

The term "genome" as it applies to a plant cells encompasses not only chromosomal DNA found within the nucleus, but organelle DNA found within subcellular components (e.g., mitochondrial, plastid) of the cell.

A "codon-optimized gene" is a gene having its frequency of codon usage designed to mimic the frequency of preferred codon usage of the host cell.

An "allele" is one of several alternative forms of a gene occupying a given locus on a chromosome. When all the alleles present at a given locus on a chromosome are the same that plant is homozygous at that locus. If the alleles present at a given locus on a chromosome differ that plant is heterozygous at that locus.

"Coding sequence" refers to a DNA sequence that codes for a specific amino acid sequence. "Regulatory sequences" refer to nucleotide sequences located upstream (5' non-coding sequences), within, or downstream (3' non-coding sequences) of a coding sequence, and which influence the transcription, RNA processing or stability, or translation of the associated coding sequence. Regulatory sequences may include, but are not limited to: promoters, translation leader sequences, introns, polyadenylation recognition sequences, RNA processing sites, effector binding sites and stem-loop structures.

"Promoter" refers to a DNA sequence capable of controlling the expression of a coding sequence or functional RNA. The promoter sequence consists of proximal and more distal upstream elements, the latter elements often referred to as enhancers. Accordingly, an "enhancer" is a DNA sequence that can stimulate promoter activity, and may be an innate element of the promoter or a heterologous element inserted to enhance the level or tissue-specificity of a promoter. Promoters may be derived in their entirety from a native gene, or be composed of different elements derived from different promoters found in nature, or even comprise synthetic DNA segments. It is understood by those skilled in the art that different promoters may direct the expression of a gene in different tissues or cell types, or at different stages of development, or in response to different environmental conditions. It is further recognized that since in most cases the exact boundaries of regulatory sequences have not been completely defined, DNA fragments of some variation may have identical promoter activity. Promoters that cause a gene to be expressed in most cell types at most times are commonly referred to as "constitutive promoters". New promoters of various types useful in plant cells are constantly being discovered; numerous examples may be found in the compilation by Okamuro, J. K., and Goldberg, R. B. *Biochemistry of Plants* 15:1-82 (1989).

"Translation leader sequence" refers to a polynucleotide sequence located between the promoter sequence of a gene and the coding sequence. The translation leader sequence is present in the fully processed mRNA upstream of the translation start sequence. The translation leader sequence may affect processing of the primary transcript to mRNA, mRNA stability or translation efficiency. Examples of translation leader sequences have been described (Turner, R. and Foster, G. D., *Mol. Biotechnol.* 3:225-236 (1995)).

"3' non-coding sequences", "transcription terminator" or "termination sequences" refer to DNA sequences located downstream of a coding sequence and include polyadenylation recognition sequences and other sequences encoding regulatory signals capable of affecting mRNA processing or gene expression. The polyadenylation signal is usually characterized by affecting the addition of polyadenylic acid tracts to the 3' end of the mRNA precursor. The use of different 3' non-coding sequences is exemplified by Ingelbrecht, I. L., et al. *Plant Cell* 1:671-680 (1989).

"RNA transcript" refers to the product resulting from RNA polymerase-catalyzed transcription of a DNA sequence. When the RNA transcript is a perfect complementary copy of the DNA sequence, it is referred to as the primary transcript. A RNA transcript is referred to as the mature RNA when it is a RNA sequence derived from post-transcriptional processing of the primary transcript. "Messenger RNA" or "mRNA" refers to the RNA that is without introns and that can be translated into protein by the cell. "cDNA" refers to a DNA that is complementary to, and synthesized from, a mRNA template using the enzyme reverse transcriptase. The cDNA can be single-stranded or converted into double-stranded form using the Klenow fragment of DNA polymerase I. "Sense" RNA refers to RNA transcript that includes the mRNA and can be translated into protein within a cell or in vitro.

"Antisense RNA" refers to an RNA transcript that is complementary to all or part of a target primary transcript or mRNA, and that blocks or reduces the expression of a target gene (U.S. Pat. No. 5,107,065). The complementarity of an antisense RNA may be with any part of the specific gene transcript, i.e., at the 5' non-coding sequence, 3' non-coding sequence, introns, or the coding sequence. "Functional RNA" refers to antisense RNA, ribozyme RNA, or other RNA that may not be translated but yet has an effect on cellular processes. The terms "complement" and "reverse complement" are used interchangeably herein with respect to mRNA transcripts, and are meant to define the antisense RNA of the message.

The term "operably linked" refers to the association of nucleic acid sequences on a single nucleic acid fragment so that the function of one is regulated by the other. For example, a promoter is operably linked with a coding sequence when it is capable of regulating the expression of that coding sequence (i.e., the coding sequence is under the transcriptional control of the promoter). Coding sequences can be operably linked to regulatory sequences in a sense or antisense orientation. In another example, the complementary RNA regions of the invention can be operably linked, either directly or indirectly, 5' to the target mRNA, or 3' to the target mRNA, or within the target mRNA, or a first complementary region is 5' and its complement is 3' to the target mRNA.

Standard recombinant DNA and molecular cloning techniques used herein are well known in the art and are described more fully in Sambrook, J., Fritsch, E. F. and Maniatis, T. Molecular Cloning: A Laboratory Manual; Cold Spring Harbor Laboratory: Cold Spring Harbor, N.Y. (1989). Transformation methods are well known to those skilled in the art and are described infra.

"PCR" or "polymerase chain reaction" is a technique for the synthesis of large quantities of specific DNA segments and consists of a series of repetitive cycles (Perkin Elmer Cetus Instruments, Norwalk, Conn.). Typically, the double-stranded DNA is heat denatured, the two primers complementary to the 3' boundaries of the target segment are annealed at low temperature and then extended at an intermediate temperature. One set of these three consecutive steps is referred to as a "cycle".

The term "recombinant" refers to an artificial combination of two otherwise separated segments of sequence, e.g., by chemical synthesis or by the manipulation of isolated segments of nucleic acids by genetic engineering techniques.

The terms "plasmid", "vector" and "cassette" refer to an extra chromosomal element often carrying genes that are not part of the central metabolism of the cell, and usually in the form of circular double-stranded DNA fragments. Such elements may be autonomously replicating sequences, genome integrating sequences, phage or nucleotide sequences, linear or circular, of a single- or double-stranded DNA or RNA, derived from any source, in which a number of nucleotide sequences have been joined or recombined into a unique construction which is capable of introducing a promoter fragment and DNA sequence for a selected gene product along with appropriate 3' untranslated sequence into a cell. "Transformation cassette" refers to a specific vector containing a foreign gene and having elements in addition to the foreign gene that facilitates transformation of a particular host cell. "Expression cassette" refers to a specific vector containing a foreign gene and having elements in addition to the foreign gene that allow for enhanced expression of that gene in a foreign host (i.e., to a discrete nucleic acid fragment into which a nucleic acid sequence or fragment can be moved.)

The terms "recombinant construct", "expression construct", "chimeric construct", "construct", and "recombinant DNA construct" are used interchangeably herein. A recombinant construct comprises an artificial combination of nucleic acid fragments, e.g., regulatory and coding sequences that are not found together in nature. For example, a chimeric construct may comprise regulatory sequences and coding sequences that are derived from different sources, or regulatory sequences and coding sequences derived from the same source, but arranged in a manner different than that found in nature. Such a construct may be used by itself or may be used in conjunction with a vector. If a vector is used, then the choice of vector is dependent upon the method that will be used to transform host cells as is well known to those skilled in the art. For example, a plasmid vector can be used. The skilled artisan is well aware of the genetic elements that must be present on the vector in order to successfully transform, select and propagate host cells comprising any of the isolated nucleic acid fragments of the invention. The skilled artisan will also recognize that different independent transformation events will result in different levels and patterns of expression (Jones et al., *EMBO J.* 4:2411-2418 (1985); De Almeida et al., *Mol. Gen. Genetics* 218:78-86 (1989)), and thus that multiple events must be screened in order to obtain lines displaying the desired expression level and pattern. Such screening may be accomplished by Southern analysis of DNA, Northern analysis of mRNA expression, immunoblotting analysis of protein expression, or phenotypic analysis, among others.

The term "expression", as used herein, refers to the production of a functional end-product (e.g., a mRNA or a protein [either precursor or mature]).

The term "introduced" means providing a nucleic acid (e.g., expression construct) or protein into a cell. Introduced includes reference to the incorporation of a nucleic acid into a eukaryotic or prokaryotic cell where the nucleic acid may be incorporated into the genome of the cell, and includes reference to the transient provision of a nucleic acid or protein to the cell. Introduced includes reference to stable or transient transformation methods, as well as sexually crossing. Thus, "introduced" in the context of inserting a nucleic acid fragment (e.g., a recombinant DNA construct/expression construct) into a cell, means "transfection" or "transformation" or "transduction" and includes reference to the incorporation of a nucleic acid fragment into a eukaryotic or prokaryotic cell where the nucleic acid fragment may be incorporated into the genome of the cell (e.g., chromosome, plasmid, plastid or mitochondrial DNA), converted into an autonomous replicon, or transiently expressed (e.g., transfected mRNA).

"Mature" protein refers to a post-translationally processed polypeptide (i.e., one from which any pre- or propeptides present in the primary translation product have been removed). "Precursor" protein refers to the primary product of translation of mRNA (i.e., with pre- and propeptides still present). Pre- and propeptides may be but are not limited to intracellular localization signals.

The term "multizyme" refers to a single polypeptide having at least two independent and separable enzymatic activities.

Preferable, the multizyme comprises a first enzymatic activity linked to a second enzymatic activity.

The term "fusion protein" is used interchangeably with the term "multizyme". Thus, a "fusion protein" refers to a single polypeptide having at least two independent and separable enzymatic activities.

The term "fusion gene" refers to a polynucleotide or gene that encodes a multizyme. A fusion gene can be constructed by linking at least two DNA fragments together wherein each DNA fragment encodes for an independent and separate enzyme activity. An example of a fusion gene is described hereinbelow in Example 21 (Hybrid1-HGLA Synthase fusion gene) which was constructed by linking the *Euglena anabaena* delta-9 elongase (EaD9Elo1; SEQ ID NO:101) and the *Tetruetreptia pomquetensis* CCMP1491 delta-8 desaturase (TpomD8; SEQ ID NO:50) using the *Euglena gracilis* DHAsynthase 1 proline-rich linker. (EgDHAsyn1Link; SEQ ID NO:97).

"DHA synthase" is another example of a multizyme. Specifically, a DHA synthase comprises a C20 elongase linked to a delta-4 desaturase.

The term "link" refers to joining or bonding at least two polypeptides having independent and separable enzyme activities.

The term "linker" refers to the bond or link between two or more polypeptides each having independent and separable enzymatic activities The link used to form a multizyme is minimally comprised of a single polypeptide bond. In another aspect, the link may be comprised of one amino acid residue, such as proline, or a polypeptide. It may be desirable that if the link is a polypeptide then it has at least one proline amino acid residue.

An example of a linker is shown in SEQ ID NO:97 (the EgDHAsyn1 proline-rich linker).

The origin of the promoter chosen to drive expression of the multizyme coding sequence is not important as long as it has sufficient transcriptional activity to express translatable mRNA for the desired nucleic acid fragments in the desired host tissue at the right time. Either heterologous or non-heterologous (i.e., endogenous) promoters can be used to practice the invention. For example, suitable promoters include, but are not limited to: the alpha prime subunit of beta conglycinin promoter, the Kunitz trypsin inhibitor 3 promoter, the annexin promoter, the glycinin Gy1 promoter, the beta subunit of beta conglycinin promoter, the P34/Gly Bd m 30K promoter, the albumin promoter, the Leg A1 promoter and the Leg A2 promoter.

"Stable transformation" refers to the transfer of a nucleic acid fragment into a genome of a host organism, including both nuclear and organellar genomes, resulting in genetically stable inheritance. In contrast, "transient transformation" refers to the transfer of a nucleic acid fragment into the nucleus, or DNA-containing organelle, of a host organism resulting in gene expression without integration or stable inheritance. Host organisms containing the transformed nucleic acid fragments are referred to as "transgenic" organisms.

As used herein, "transgenic" refers to a plant or a cell which comprises within its genome a heterologous polynucleotide. Preferably, the heterologous polynucleotide is stably integrated within the genome such that the polynucleotide is passed on to successive generations. The heterologous polynucleotide may be integrated into the genome alone or as part of an expression construct. Transgenic is used herein to include any cell, cell line, callus, tissue, plant part or plant, the genotype of which has been altered by the presence of heterologous nucleic acid including those transgenics initially so altered as well as those created by sexual crosses or asexual propagation from the initial transgenic. The term "transgenic" as used herein does not encompass the alteration of the genome (chromosomal or extra-chromosomal) by conventional plant breeding methods or by naturally occurring events such as random cross-fertilization, non-recombinant viral infection, non-recombinant bacterial transformation, non-recombinant transposition, or spontaneous mutation.

"Antisense inhibition" refers to the production of antisense RNA transcripts capable of suppressing the expression of the target protein. "Co-suppression" refers to the production of sense RNA transcripts capable of suppressing the expression of identical or substantially similar foreign or endogenous genes (U.S. Pat. No. 5,231,020). Co-suppression constructs in plants previously have been designed by focusing on overexpression of a nucleic acid sequence having homology to an endogenous mRNA, in the sense orientation, which results in the reduction of all RNA having homology to the overexpressed sequence (Vaucheret et al., *Plant J.* 16:651-659 (1998); Gura, *Nature* 404:804-808 (2000)). The overall efficiency of this phenomenon is low, and the extent of the RNA reduction is widely variable. More recent work has described the use of "hairpin" structures that incorporate all, or part, of an mRNA encoding sequence in a complementary orientation that results in a potential "stem-loop" structure for the expressed RNA (PCT Publication No. WO 99/53050, published Oct. 21, 1999; PCT Publication No. WO 02/00904, published Jan. 3, 2002). This increases the frequency of co-suppression in the recovered transgenic plants. Another variation describes the use of plant viral sequences to direct the suppression, or "silencing", of proximal mRNA encoding sequences (PCT Publication No. WO 98/36083, published Aug. 20, 1998). Both of these co-suppressing phenomena have not been elucidated mechanistically, although genetic evidence has begun to unravel this complex situation (El-mayan et al., *Plant Cell* 10:1747-1757 (1998)). "Down-regulation" can be accomplished by any of the technologies of co-suppression, RNAi, antisense RNA or miRNA (micro RNA). miRNAs are regulatory agents consisting of about 22 ribonucleotides. miRNAs are highly efficient at inhibiting the expression of endogenous genes. See, for example Javier et al., *Nature* 425:257-263 (2003), herein incorporated by reference.

The term "Euglenophyceae" refers to a group of unicellular colorless or photosynthetic flagellates ("euglenoids") found living in freshwater, marine, soil, and parasitic environments. The class is characterized by solitary unicells, wherein most are free-swimming and have two flagella (one of which may be nonemergent) arising from an anterior invagination known as a reservoir. Photosynthetic euglenoids contain one to many grass-green chloroplasts, which vary from minute disks to expanded plates or ribbons. Colorless euglenoids depend on osmotrophy or phagotrophy for nutrient assimilation. About 1000 species have been described and classified into about 40 genera and 6 orders. Examples of Euglenophyceae include, but are no means limited to, the following genera: *Eutreptiella* and *Tetruetreptia*.

The term "plant" refers to whole plants, plant organs, plant tissues, seeds, plant cells, seeds and progeny of the same. Plant cells include, without limitation, cells from seeds, suspension cultures, embryos, meristematic regions, callus tissue, leaves, roots, shoots, gametophytes, sporophytes, pollen and microspores.

"Progeny" comprises any subsequent generation of a plant. The present invention relates to production of arachidonic acid in oilseed plants. More specifically, the present invention relates to transgenic soybean and *Arabidopsis* seeds containing at least 10% arachidonic acid and a reduced content of omega-3 fatty acids. The present invention also relates to transgenic soybean and *Arabidopsis* seeds containing at least 10% arachidonic acid, a reduced content of omega-3 fatty acids and a reduced content of gamma-linolenic acid.

The present invention concerns transgenic oilseed plants that are capable of producing mature seeds in which the total seed fatty acid profile comprises at least 10% arachidonic acid (ARA, 20:4, omega-6) and less than 5% total omega-3 fatty acids having at least eighteen carbon atoms and at least four double bonds.

Also of interest is a transgenic oilseed plant that produces mature seeds in which the total seed fatty acid profile comprises at least 10.0% arachidonic acid and less than 1% total omega-3 fatty acids having at least eighteen carbon atoms and at least four double bonds.

In another aspect the present invention concerns a transgenic oilseed plant that produces mature seeds in which the total seed fatty acid profile comprises at least 10.0% arachidonic acid and less than 5% gamma-linolenic acid.

In still a further aspect, the present invention concerns a transgenic oilseed plant that produces mature seeds in which the total seed fatty acid profile comprises at least 10.0% arachidonic acid and less than or equal to 1% gamma-linolenic acid.

In still an even further aspect, the present invention concerns a transgenic oilseed plant that produces mature seeds in which the total seed fatty acid profile comprises at least 10.0% arachidonic acid and less than or equal to 1% gamma-linolenic acid and less than 1% total omega-3 fatty acids having at least eighteen carbon atoms and at least four double bonds.

Accumulation of this particular polyunsaturated fatty acid (PUFA) may be accomplished by introduction of either of two different functional omega-3/omega-6 fatty acid biosynthetic pathways. The first pathway utilizes, inter alia, proteins with delta-6 desaturase, $C_{18/20}$ elongase and delta-5 desaturase activities into the host for high-level recombinant expression, wherein the ARA oil also comprises GLA.

The other pathway utilizes, inter alia, proteins with delta-9 elongase, delta-8 desaturase and delta-5 desaturase activities and thereby enables production of an ARA oil that is devoid of any GLA. Production of high-levels of ARA with a reduced content of omega-3 fatty acids (i.e., EPA) may be accomplished, but not limited to, either of the above pathways in combination with down-regulation of the fad3 gene which encodes an enzyme having delta-15 desaturase activity. Additionally, crossing soybeans expressing either pathway for ARA production with transgenic or non-transgenic "low-lin" soybeans can be used to reduce the content of omega-3 fatty acids such as EPA. Furthermore, introduction of either pathway into a host plant that naturally does not make high levels of ALA such as corn, sunflower or safflower can also be used to produce ARA with a low content of omega-3 fatty acids.

"Delta-15 desaturase" refers to a fatty acid desaturase that catalyzes the formation of a double bond between carbon positions 3 and 4 (numbered from the methyl end), (i.e., those that correspond to carbon positions 15 and 16 (numbered from the carbonyl carbon) of an 18 carbon-long fatty acyl chain and carbon positions 13 and 14 (numbered from the carbonyl carbon) of a 16 carbon-long fatty acyl chain). Down-regulation of the fad3 gene is described in U.S. Pat. No. 5,952,544 issued to Browse et al. on Sep. 14, 1999.

PUFAs such as ARA, or derivatives thereof, made by the methodology disclosed herein can be used as dietary substitutes, or supplements, particularly infant formulas, for patients undergoing intravenous feeding or for preventing or treating malnutrition. Alternatively, the purified PUFAs (or derivatives thereof) may be incorporated into cooking oils, fats or margarines formulated so that in normal use the recipient would receive the desired amount for dietary supplementation. The PUFAs may also be incorporated into infant formulas, nutritional supplements or other food products and may find use as anti-inflammatory or cholesterol lowering agents. Optionally, the compositions may be used for pharmaceutical use (human or veterinary). In this case, the PUFAs are generally administered orally but can be administered by any route by which they may be successfully absorbed, e.g., parenterally (e.g., subcutaneously, intramuscularly or intravenously), rectally, vaginally or topically (e.g., as a skin ointment or lotion).

Supplementation of human or animal diets with PUFAs produced by recombinant means can result in increased levels of the added PUFAs, as well as metabolites thereof. For example, treatment with EPA can result not only in increased levels of EPA, but also downstream products of EPA such as eicosanoids (i.e., prostaglandins, leukotrienes, thromboxanes). Complex regulatory mechanisms can make it desirable to combine various PUFAs, or add different conjugates of PUFAs, in order to prevent, control or overcome such mechanisms to achieve the desired levels of specific PUFA(s) in an individual.

Biosynthesis of ARA (an Omega-6 Fatty Acids):

The metabolic process wherein oleic acid is converted to ARA involves elongation of the carbon chain through the addition of carbon atoms and desaturation of the molecule through the addition of double bonds. This requires a series of special desaturation and elongation enzymes. However, as seen in FIG. 1 and as described below, two alternate pathways exist for Specifically, both pathways require the initial conversion of oleic acid to LA (18:2), the first of the omega-6 fatty acids, by a delta-12 desaturase. Then, using the "delta-6 desaturase/delta-6 elongase pathway for ARA biosynthesis, PUFAs are formed as follows: (1) LA is converted to GLA by the activity of a delta-6 desaturase; (2) GLA is converted to DGLA by the action of a $C_{18/20}$ elongase; and (3) DGLA is converted to ARA by the action of a delta-5 desaturase.

Alternatively, the "delta-9 elongase/delta-8 desaturase pathway" can be utilized for formation of ARA as follows: (1) LA is converted to EDA by a delta-9 elongase; (2) EDA is converted to DGLA by a delta-8 desaturase; and (3) DGLA is converted to ARA by a delta-5 desaturase.

One skilled in the art will be able to identify various candidate genes encoding each of the enzymes desired for ARA biosynthesis. Useful desaturase and elongase sequences may be derived from any source, e.g., isolated from a natural source (from bacteria, algae, fungi, plants, animals, etc.), produced via a semi-synthetic route or synthesized de novo. Although the particular source of the desaturase and elongase genes introduced into the host is not critical, considerations for choosing a specific polypeptide having desaturase or elongase activity include: (1) the substrate specificity of the polypeptide; (2) whether the polypeptide or a component thereof is a rate-limiting enzyme; (3) whether the desaturase or elongase is essential for synthesis of a desired PUFA; and/or (4) co-factors required by the polypeptide. The expressed polypeptide preferably has parameters compatible with the biochemical environment of its location in the host cell (see PCT Publication No. WO 04/101757 for additional details).

In additional embodiments, it will also be useful to consider the conversion efficiency of each particular desaturase and/or elongase. More specifically, since each enzyme rarely functions with 100% efficiency to convert substrate to product, the final lipid profile of unpurified oils produced in a host cell will typically be a mixture of various PUFAs consisting of the desired omega-3/omega-6 fatty acid, as well as various upstream intermediary PUFAs. Thus, consideration of each enzyme's conversion efficiency is also a variable when optimizing biosynthesis of a desired fatty acid that must be considered in light of the final desired lipid profile of the product.

With each of the considerations above in mind, candidate genes having the appropriate desaturase and elongase activities can be identified according to publicly available literature (e.g., GenBank), the patent literature, and experimental analysis of microorganisms having the ability to produce PUFAs. For instance, the following GenBank Accession Numbers refer to examples of publicly available genes useful in ARA biosynthesis: AY131238, Y055118, AY055117, AF296076, AF007561, L11421, NM_031344, AF465283, AF465281, AF110510, AF465282, AF419296, AB052086, AJ250735, AF126799, AF126798 ($\square$6 desaturases); AF390174 ($\square$9 elongase); AF139720 ($\square$8 desaturase); AF199596, AF226273, AF320509, AB072976, AF489588, AJ510244, AF419297, AF07879, AF067654, AB022097 ($\square$5 desaturases); AAG36933, AF110509, AB020033, AAL13300, AF417244, AF161219, AY332747, AAG36933, AF110509, AB020033, AAL13300, AF417244, AF161219, X86736, AF240777, AB007640, AB075526, AP002063 ($\square$12 desaturases); AF338466, AF438199, E11368, E11367, D83185, U90417, AF085500, AY504633, NM_069854, AF230693 ($\square$9 desaturases); and NP_012339, NP_009963, NP_013476, NP_599209, BAB69888, AF244356, AAF70417, AAF71789, AF390174, AF428243, NP_955826, AF206662, AF268031, AY591335, AY591336, AY591337, AY591338, AY605098, AY605100, AY630573 ($C_{14/16}$, $C_{16/18}$ and $C_{18/20}$, elongases). Similarly, the patent literature provides many additional DNA sequences of genes (and/or details concerning several of the genes above and their methods of isolation) involved in PUFA production [e.g., WO 02/077213 ($\square$9 elongases); WO 00/34439 and WO 04/057001 ($\square$8 desaturases); U.S. Pat. No. 5,968,809 ($\square$6 desaturases); U.S. Pat. No. 5,972,664 and U.S. Pat. No. 6,075,183 ($\square$5 desaturases); WO 94/11516, U.S. Pat. No. 5,443,974, WO 03/099216 and WO 05/047485 ($\square$12 desaturases); WO 91/13972 and U.S. Pat. No. 5,057,419 ($\square$9 desaturases); and, WO 00/12720, U.S. Pat. No. 6,403,349, U.S. Pat. No. 6,677,145, U.S. 2002/0139974A1, U.S. 2004/0111763 ($C_{14/16}$, $C_{16/18}$ and $C_{18/20}$ elongases)]. Each of these patents and applications are herein incorporated by reference in their entirety.

It is contemplated that the foregoing discussion is intended to be exemplary and not limiting. Accordingly, numerous other genes encoding: (1) delta-6 desaturases, $C_{18/20}$ elongases and delta-5 desaturases (and optionally other genes encoding delta-9 desaturases, delta-12 desaturases, $C_{14/16}$ elongases and/or $C_{16/18}$ elongases); or (2) delta-9 elongases, delta-8 desaturases and delta-5 desaturases (and optionally other genes encoding delta-9 desaturases, delta-12 desaturases, $C_{14/16}$ elongases and/or $C_{16/18}$ elongases) derived from different sources would be suitable for modifying the genome of an oilseed plant.

At times, it may be desirable to minimize by-product fatty acids. The relative abundance of by-product fatty acids could be decreased by increasing total delta-8 desaturase activity. One approach to minimize by-product fatty acids would be to express more than one delta-8 desaturase (i.e., the same or different delta-8 desaturase). For instance, the presence of sciadonic acid (SCI) and/or juniperonic acid (JUP) [commonly found in the seed lipids of gymnosperms (Wolff et al., *Lipids* 35(1):1-22 (2000)), such as those in the Pinaceae family (pine)] might be considered by-product fatty acids of a delta-6 desaturase/delta-6 elongase pathway or delta-9-elongase/delta-8 desaturase pathway. Although these fatty acids are considered to have various health-enhancing properties themselves (Nakane et al., *Biol. Pharm. Bull.* 23: 758-761 (2000)), their presence as by-product fatty acids in an engineered PUFA pathway, such as in an oilseed crop, may not be desirable depending on the application.

The term "delta-6 desaturase/delta-6 elongase pathway" also refers to a biosynthetic pathway for production of long-chain PUFAs. This pathway, at a minimum, comprises a delta-6 desaturase and a delta-6 elongase, thereby enabling biosynthesis of DGLA and/or ETA from LA and ALA, respectively. With expression of other desaturases and elongases, ARA, EPA, DPA and DHA may also be synthesized. Occasionally, a delta-6 elongase may elongate fatty acids other than the intended fatty acid. For instance, delta-6 elongases generally convert GLA to DGLA but some delta-6 elongases may also convert unintended substrates such as LA or ALA to EDA or ETrA, respectively. In a delta-6 desaturase/delta-6 elongase pathway, EDA and ETrA would be considered "by-product fatty acids" as defined below. Addition of a delta-8 desaturase to a delta-6 desaturase/delta-6 elongase pathway would provided a means to convert the "by-product fatty acids" EDA and ETrA back into the "intermediate fatty acids" (as defined below) DGLA and ETA, respectively.

Plant Expression Systems, Cassettes and Vectors, and Transformation

A promoter is a DNA sequence that directs cellular machinery of a plant to produce RNA from the contiguous coding sequence downstream (3') of the promoter. The promoter region influences the rate, developmental stage, and cell type in which the RNA transcript of the gene is made. The RNA transcript is processed to produce mRNA which serves as a template for translation of the RNA sequence into the amino acid sequence of the encoded polypeptide. The 5' non-translated leader sequence is a region of the mRNA upstream of the protein coding region that may play a role in initiation and translation of the mRNA. The 3' transcription termination/polyadenylation signal is a non-translated region downstream of the protein coding region that functions in the plant cell to cause termination of the RNA transcript and the addition of polyadenylate nucleotides to the 3' end of the RNA.

The origin of the promoter chosen to drive expression of the coding sequence is not important as long as it has sufficient transcriptional activity to accomplish the invention by expressing translatable mRNA for the desired nucleic acid fragments in the desired host tissue at the right time. Either heterologous or non-heterologous (i.e., endogenous) promoters can be used to practice the invention. For example, suitable promoters include, but are not limited to: the alpha prime subunit of beta conglycinin promoter, the Kunitz trypsin inhibitor 3 promoter, the annexin promoter, the glycinin Gy1 promoter, the beta subunit of beta conglycinin promoter, the P34/Gly Bd m 30K promoter, the albumin promoter, the Leg A1 promoter and the Leg A2 promoter.

The annexin, or P34, promoter is described in PCT Publication No. WO 04/071178 (published Aug. 26, 2004). The level of activity of the annexin promoter is comparable to that of many known strong promoters, such as: (1) the CaMV 35S promoter (Atanassova et al., *Plant Mol. Biol.* 37:275-285 (1998); Battraw and Hall, *Plant Mol. Biol.* 15:527-538 (1990); Holtorf et al., *Plant Mol. Biol.* 29:637-646 (1995); Jefferson et al., *EMBO J.* 6:3901-3907 (1987); Wilmink et al., *Plant Mol. Biol.* 28:949-955 (1995)); (2) the *Arabidopsis* oleosin promoters (Plant et al., *Plant Mol. Biol.* 25:193-205 (1994); Li, Texas A&M University Ph.D. dissertation, pp. 107-128 (1997)); (3) the *Arabidopsis* ubiquitin extension protein promoters (Callis et al., *J Biol. Chem.* 265(21):12486-93 (1990)); (4) a tomato ubiquitin gene promoter (Rollfinke et al., *Gene.* 211(2):267-76 (1998)); (5) a soybean heat shock protein promoter (Schoffl et al., *Mol Gen Genet.* 217(2-3): 246-53 (1989)); and, (6) a maize H3 histone gene promoter (Atanassova et al., *Plant Mol Biol.* 37(2):275-85 (1989)).

Another useful feature of the annexin promoter is its expression profile in developing seeds. The annexin promoter is most active in developing seeds at early stages (before 10 days after pollination) and is largely quiescent in later stages. The expression profile of the annexin promoter is different from that of many seed-specific promoters, e.g., seed storage protein promoters, which often provide highest activity in later stages of development (Chen et al., *Dev. Genet.* 10:112-122 (1989); Ellerstrom et al., *Plant Mol. Biol.* 32:1019-1027 (1996); Keddie et al., *Plant Mol. Biol.* 24:327-340 (1994); Plant et al., (supra); Li, (supra)). The annexin promoter has a more conventional expression profile but remains distinct from other known seed specific promoters. Thus, the annexin promoter will be a very attractive candidate when overexpression, or suppression, of a gene in embryos is desired at an early developing stage. For example, it may be desirable to overexpress a gene regulating early embryo development or a gene involved in the metabolism prior to seed maturation.

Following identification of an appropriate promoter suitable for expression of a coding sequence, the promoter is then operably linked in a sense orientation using conventional means well known to those skilled in the art.

Standard recombinant DNA and molecular cloning techniques used herein are well known in the art and are described more fully in Sambrook, J. et al., In *Molecular Cloning: A Laboratory Manual;* $2^{nd}$ ed.; Cold Spring Harbor Laboratory Press: Cold Spring Harbor, N.Y., 1989 (hereinafter "Sambrook et al., 1989") or Ausubel, F. M., Brent, R., Kingston, R. E., Moore, D. D., Seidman, J. G., Smith, J. A. and Struhl, K., Eds.; In *Current Protocols in Molecular Biology*; John Wiley and Sons: New York, 1990 (hereinafter "Ausubel et al., 1990"). For example, a fusion gene can be constructed by linking at least two DNA fragments in frame so as not to introduce a stop codon (in-frame fusion). The resulting fusion gene will be such that each DNA fragment encodes for an independent and separate enzyme activity.

Once the recombinant construct has been made, it may then be introduced into a plant cell of choice by methods well known to those of ordinary skill in the art (e.g., transfection, transformation and electroporation). Oilseed plant cells are the preferred plant cells. The transformed plant cell is then cultured and regenerated under suitable conditions permitting expression of the long-chain PUFA which is then optionally recovered and purified.

The recombinant constructs of the invention may be introduced into one plant cell; or, alternatively, each construct may be introduced into separate plant cells.

Expression in a plant cell may be accomplished in a transient or stable fashion as is described above.

The desired long-chain PUFAs can be expressed in seed. Also within the scope of this invention are seeds or plant parts obtained from such transformed plants.

Plant parts include differentiated and undifferentiated tissues including, but not limited to the following: roots, stems, shoots, leaves, pollen, seeds, tumor tissue and various forms of cells and culture (e.g., single cells, protoplasts, embryos and callus tissue). The plant tissue may be in plant or in a plant organ, tissue or cell culture.

The term "plant organ" refers to plant tissue or a group of tissues that constitute a morphologically and functionally distinct part of a plant. The term "genome" refers to the following: (1) the entire complement of genetic material (genes and non-coding sequences) that is present in each cell of an organism, or virus or organelle; and/or (2) a complete set of chromosomes inherited as a (haploid) unit from one parent.

Thus, this invention also concerns a method for transforming a cell, comprising transforming a cell with the recombinant construct of the invention and selecting those cells transformed with one of the recombinant constructs of the invention.

Also of interest is a method for producing a transformed plant comprising transforming a plant cell with the polynucleotides of the instant invention and regenerating a plant from the transformed plant cell.

Methods for transforming dicots (primarily by use of *Agrobacterium tumefaciens*) and obtaining transgenic plants have been published, among others, for: cotton (U.S. Pat. No. 5,004,863; U.S. Pat. No. 5,159,135); soybean (U.S. Pat. No. 5,569,834; U.S. Pat. No. 5,416,011); *Brassica* (U.S. Pat. No. 5,463,174); peanut (Cheng et al. *Plant Cell Rep.* 15:653-657 (1996); McKently et al. *Plant Cell Rep.* 14:699-703 (1995)); papaya (Ling, K. et al. *Bio/technology* 9:752-758 (1991)); and pea (Grant et al. *Plant Cell Rep.* 15:254-258 (1995)). For a review of other commonly used methods of plant transformation see Newell, C. A. (*Mol. Biotechnol.* 16:53-65 (2000)). One of these methods of transformation uses *Agrobacterium rhizogenes* (Tepfler, M. and Casse-Delbart, F. *Microbiol. Sci.* 4:24-28 (1987)). Transformation of soybeans using direct delivery of DNA has been published using PEG fusion (PCT Publication No. WO 92/17598), electroporation (Chowrira, G. M. et al., *Mol. Biotechnol.* 3:17-23 (1995); Christou, P. et al., *Proc. Natl. Acad. Sci.* U.S.A. 84:3962-3966 (1987)), microinjection and particle bombardment (McCabe, D. E. et. al., *Bio/Technology* 6:923 (1988); Christou et al., *Plant Physiol.* 87:671-674 (1988)).

There are a variety of methods for the regeneration of plants from plant tissue. The particular method of regeneration will depend on the starting plant tissue and the particular plant species to be regenerated. The regeneration, development and cultivation of plants from single plant protoplast transformants or from various transformed explants is well known in the art (Weissbach and Weissbach, In: Methods for Plant Molecular Biology, (Eds.), Academic: San Diego, Calif. (1988)). This regeneration and growth process typically includes the steps of selection of transformed cells and culturing those individualized cells through the usual stages of embryonic development through the rooted plantlet stage. Transgenic embryos and seeds are similarly regenerated. The resulting transgenic rooted shoots are thereafter planted in an appropriate plant growth medium such as soil. Preferably, the regenerated plants are self-pollinated to provide homozygous transgenic plants. Otherwise, pollen obtained from the regenerated plants is crossed to seed-grown plants of agronomically important lines. Conversely, pollen from plants of these important lines is used to pollinate regenerated plants. A transgenic plant of the present invention containing a desired polypeptide is cultivated using methods well known to one skilled in the art.

In addition to the above discussed procedures, practitioners are familiar with the standard resource materials which describe specific conditions and procedures for: the construction, manipulation and isolation of macromolecules (e.g., DNA molecules, plasmids, etc.); the generation of recombinant DNA fragments and recombinant expression constructs; and, the screening and isolating of clones. See, for example: Sambrook et al., Molecular Cloning: A Laboratory Manual, Cold Spring Harbor: N.Y. (1989); Maliga et al., Methods in Plant Molecular Biology, Cold Spring Harbor: N.Y. (1995); Birren et al., Genome Analysis: Detecting Genes, Vol. 1, Cold Spring Harbor: N.Y. (1998); Birren et al., Genome Analysis: Analyzing DNA, Vol. 2, Cold Spring Harbor: N.Y. (1998); Plant Molecular Biology: A Laboratory Manual, eds. Clark, Springer: N.Y. (1997).

Examples of oilseed plants include, but are not limited to: soybean, *Brassica* species, sunflower, maize, cotton, flax and safflower. Seeds obtained from such plants are also within the scope of this invention as well as oil obtained from such seeds.

The choice of combination of cassettes used for ARA production depends in part on the PUFA profile and/or desaturase/elongase profile of the oilseed plant cells to be transformed.

Purification and Processing of PUFA Oils

PUFAs may be found in the host plants as free fatty acids or in esterified forms such as acylglycerols, phospholipids, sulfolipids or glycolipids, and may be extracted from the host cells through a variety of means well-known in the art. One review of extraction techniques, quality analysis and acceptability standards for yeast lipids is that of Z. Jacobs (*Critical Reviews in Biotechnology*, 12(5/6):463-491 (1992)). A brief review of downstream processing is also available by A. Singh and O. Ward (*Adv. Appl. Microbiol.*, 45:271-312 (1997)).

In general, means for the purification of PUFAs may include extraction with organic solvents, sonication, supercritical fluid extraction (e.g., using carbon dioxide), saponification and physical means such as presses, or combinations thereof. One is referred to the teachings of PCT Publication No. WO 04/101757 for additional details. Methods of isolating seed oils are well known in the art: (Young et al., Processing of Fats and Oils, In *The Lipid Handbook*, Gunstone et al., eds., Chapter 5 pp 253-257; Chapman & Hall: London (1994)). For example, soybean oil is produced using a series of steps involving the extraction and purification of an edible oil product from the oil-bearing seed. Soybean oils and soybean byproducts are produced using the generalized steps shown in Table 6.

TABLE 6

Generalized Steps for Soybean Oil and Byproduct Production

| Process Step | Process | Impurities Removed and/or By-Products Obtained |
|---|---|---|
| #1 | soybean seed | |
| #2 | oil extraction | meal |
| #3 | degumming | lecithin |
| #4 | alkali or physical refining | gums, free fatty acids, pigments |
| #5 | water washing | soap |
| #6 | bleaching | color, soap, metal |
| #7 | (hydrogenation) | |
| #8 | (winterization) | stearine |
| #9 | deodorization | free fatty acids, tocopherols, sterols, volatiles |
| #10 | oil products | |

More specifically, soybean seeds are cleaned, tempered, dehulled and flaked, thereby increasing the efficiency of oil extraction. Oil extraction is usually accomplished by solvent (e.g., hexane) extraction but can also be achieved by a combination of physical pressure and/or solvent extraction. The resulting oil is called crude oil. The crude oil may be degummed by hydrating phospholipids and other polar and neutral lipid complexes that facilitate their separation from the nonhydrating, triglyceride fraction (soybean oil). The resulting lecithin gums may be further processed to make commercially important lecithin products used in a variety of food and industrial products as emulsification and release (i.e., antisticking) agents. Degummed oil may be further refined for the removal of impurities (primarily free fatty acids, pigments and residual gums). Refining is accomplished by the addition of a caustic agent that reacts with free fatty acid to form soap and hydrates phosphatides and proteins in the crude oil. Water is used to wash out traces of soap formed during refining. The soapstock byproduct may be used directly in animal feeds or acidulated to recover the free fatty acids. Color is removed through adsorption with a bleaching earth that removes most of the chlorophyll and carotenoid compounds. The refined oil can be hydrogenated, thereby resulting in fats with various melting properties and textures. Winterization (fractionation) may be used to remove stearine from the hydrogenated oil through crystallization under carefully controlled cooling conditions. Deodorization (principally via steam distillation under vacuum) is the last step and is designed to remove compounds which impart odor or flavor to the oil. Other valuable byproducts such as tocopherols and sterols may be removed during the deodorization process. Deodorized distillate containing these byproducts may be sold for production of natural vitamin E and other high-value pharmaceutical products. Refined, bleached, (hydrogenated, fractionated) and deodorized oils and fats may be packaged and sold directly or further processed into more specialized products. A more detailed reference to soybean seed processing, soybean oil production and byproduct utilization can be found in Erickson, Practical Handbook of Soybean Processing and Utilization, The American Oil Chemists' Society and United Soybean Board (1995). Soybean oil is liquid at room temperature because it is relatively low in saturated fatty acids when compared with oils such as coconut, palm, palm kernel and cocoa butter.

Plant oils containing PUFAs that have been refined and/or purified can be hydrogenated, to thereby result in fats with various melting properties and textures. Many processed fats (including spreads, confectionary fats, hard butters, margarines, baking shortenings, etc.) require varying degrees of solidity at room temperature and can only be produced through alteration of the source oil's physical properties. This is most commonly achieved through catalytic hydrogenation.

Hydrogenation is a chemical reaction in which hydrogen is added to the unsaturated fatty acid double bonds with the aid of a catalyst such as nickel. For example, high oleic soybean oil contains unsaturated oleic, LA and linolenic fatty acids and each of these can be hydrogenated. Hydrogenation has two primary effects. First, the oxidative stability of the oil is increased as a result of the reduction of the unsaturated fatty acid content. Second, the physical properties of the oil are changed because the fatty acid modifications increase the melting point resulting in a semi-liquid or solid fat at room temperature.

There are many variables which affect the hydrogenation reaction, which in turn alter the composition of the final product. Operating conditions including pressure, temperature, catalyst type and concentration, agitation and reactor design are among the more important parameters that can be controlled. Selective hydrogenation conditions can be used to hydrogenate the more unsaturated fatty acids in preference to the less unsaturated ones. Very light or brush hydrogenation is often employed to increase stability of liquid oils. Further hydrogenation converts a liquid oil to a physically solid fat. The degree of hydrogenation depends on the desired performance and melting characteristics designed for the particular end product. Liquid shortenings (used in the manufacture of baking products, solid fats and shortenings used for commercial frying and roasting operations) and base stocks for margarine manufacture are among the myriad of possible oil and fat products achieved through hydrogenation. A more detailed description of hydrogenation and hydrogenated products can be found in Patterson, H. B. W., Hydrogenation of Fats and Oils: Theory and Practice. The American Oil Chemists' Society (1994).

Hydrogenated oils have become somewhat controversial due to the presence of trans-fatty acid isomers that result from the hydrogenation process. Ingestion of large amounts of trans-isomers has been linked with detrimental health effects including increased ratios of low density to high density lipoproteins in the blood plasma and increased risk of coronary heart disease.

PUFA-Containing Oils for Use in Foodstuffs

Nutritional compositions include and food or preparation for human consumption including for enteral or parenteral consumption, which when consumed (a) nourish or build up tissues or supply energy and/or (b) maintain, restore or support adequate nutritional status or metabolic function. Such compositions comprise at least one oil or acid produced in accordance with the instant invention and may either be in a solid or liquid form. Additionally, the composition may include edible macronutrients, vitamins and minerals in amounts suitable for achieving the intended purpose. For example, amounts will vary if the use is intended for normal, healthy infants, children or adults having specialized needs such as those which accompany certain metabolic conditions.

Examples of macronutrients which may be added to the composition include but are not limited to edible fats, carbohydrates and proteins. Examples of suitable edible fats include but are not limited to coconut oil, soy oil, and mono- and diglycerides. Glucose, edible lactose and hydrolyzed starch can be mentioned as examples of carbohydrates. Examples of suitable proteins include, but are not limited to, soy proteins, electrodialyzed whey, electodilayzed skim milk, milk whey or the hydrolysates of these proteins. Examples of suitable vitamins and minerals include, but are not limited to, calcium, phosphorus, potassium, sodium, chloride, magnesium, manganese, iron, copper, zinc, selenium, iodine, and Vitamins A, E, D, C, and B complex.

Examples of nutritional compositions include, but are not limited to, infant formulas, dietary supplements and rehydration compositions.

The market place currently supports a large variety of food and feed products, incorporating omega-3 and/or omega-6 fatty acids (particularly ARA, EPA and DHA). It is contemplated that the plant/seed oils and altered seed oils of the invention comprising PUFAs will function in food and feed products to impart the health benefits of current formulations. Compared to other vegetable oils, the oils of the invention are believed to function similarly to other oils in food applications from a physical standpoint (for example, partially hydrogenated oils such as soybean oil are widely used as ingredients for soft spreads, margarine and shortenings for baking and frying).

Plant/seed oils and altered seed oils containing omega-3 and/or omega-6 fatty acids as described herein will be suitable for use in a variety of food and feed products including, but not limited to: food analogs, meat products, cereal products, baked foods, snack foods and dairy products. Additionally, the present plant/seed oils and altered seed oils may be used in formulations to impart health benefit in medical foods including medical nutritionals, dietary supplements, infant formula as well as pharmaceutical products. One of skill in the art of food processing and food formulation will understand how the amount and composition of the plant oils may be added to the food or feed product. Such an amount will be referred to herein as an "effective" amount and will depend on the food or feed product, the diet that the product is intended to supplement or the medical condition that the medical food or medical nutritional is intended to correct or treat.

Food analogs can be made using processes well known to those skilled in the art. There can be mentioned meat analogs, cheese analogs, milk analogs and the like. Meat analogs made from soybeans contain soy protein or tofu and other ingredients mixed together to simulate various kinds of meats. These meat alternatives are sold as frozen, canned or dried foods. Usually, they can be used the same way as the foods they replace. Meat alternatives made from soybeans are excellent sources of protein, iron and B vitamins. Examples of meat analogs include, but are not limited to: ham analogs, sausage analogs, bacon analogs, and the like.

Food analogs can be classified as imitation or substitutes depending on their functional and compositional characteristics. For example, an imitation cheese need only resemble the cheese it is designed to replace. However, a product can generally be called a substitute cheese only if it is nutritionally equivalent to the cheese it is replacing and meets the minimum compositional requirements for that cheese. Thus, substitute cheese will often have higher protein levels than imitation cheeses and be fortified with vitamins and minerals.

Milk analogs or nondairy food products include, but are not limited to, imitation milks and nondairy frozen desserts (e.g., those made from soybeans and/or soy protein products).

Meat products encompass a broad variety of products. In the United States "meat" includes "red meats" produced from cattle, hogs and sheep. In addition to the red meats there are poultry items which include chickens, turkeys, geese, guineas, ducks and the fish and shellfish. There is a wide assortment of seasoned and processed meat products: fresh, cured and fried, and cured and cooked. Sausages and hot dogs are examples of processed meat products. Thus, the term "meat products" as used herein includes, but is not limited to, processed meat products.

A cereal food product is a food product derived from the processing of a cereal grain. A cereal grain includes any plant from the grass family that yields an edible grain (seed). The most popular grains are barley, corn, millet, oats, quinoa, rice, rye, sorghum, triticale, wheat and wild rice. Examples of a cereal food product include, but are not limited to: whole grain, crushed grain, grits, flour, bran, germ, breakfast cereals, extruded foods, pastas, and the like.

A baked goods product comprises any of the cereal food products mentioned above and has been baked or processed in a manner comparable to baking (i.e., to dry or harden by subjecting to heat). Examples of a baked good product include, but are not limited to: bread, cakes, doughnuts, bars, pastas, bread crumbs, baked snacks, mini-biscuits, mini-crackers, mini-cookies, and mini-pretzels. As was mentioned above, oils of the invention can be used as an ingredient.

A snack food product comprises any of the above or below described food products.

A fried food product comprises any of the above or below described food products that has been fried.

A health food product is any food product that imparts a health benefit. Many oilseed-derived food products may be considered as health foods.

A beverage can be in a liquid or in a dry powdered form.

For example, there can be mentioned non-carbonated drinks such as fruit juices, fresh, frozen, canned or concentrate; flavored or plain milk drinks, etc. Adult and infant nutritional formulas are well known in the art and commercially available (e.g., Similac®, Ensure®, Jevity®, and Alimentum® from Ross Products Division, Abbott Laboratories).

Infant formulas are liquids or reconstituted powders fed to infants and young children. "Infant formula" is defined herein as an enteral nutritional product which can be substituted for human breast milk in feeding infants and typically is composed of a desired percentage of fat mixed with desired percentages of carbohydrates and proteins in an aqueous solution (e.g., see U.S. Pat. No. 4,670,285). Based on the worldwide composition studies, as well as levels specified by expert groups, average human breast milk typically contains about 0.20% to 0.40% of total fatty acids (assuming about 50% of calories from fat); and, generally the ratio of DHA to ARA would range from about 1:1 to 1:2 (see, e.g., formulations of Enfamil LIPIL™ (Mead Johnson & Company) and Similac Advance™ (Ross Products Division, Abbott Laboratories)). Infant formulas have a special role to play in the diets of infants because they are often the only source of nutrients for infants; and, although breast-feeding is still the best nourishment for infants, infant formula is a close enough second that babies not only survive but thrive.

A dairy product is a product derived from milk. A milk analog or nondairy product is derived from a source other than milk, for example, soymilk as was discussed above. These products include, but are not limited to: whole milk, skim milk, fermented milk products such as yogurt or sour milk, cream, butter, condensed milk, dehydrated milk, coffee whitener, coffee creamer, ice cream, cheese, etc.

Additional food products into which the PUFA-containing oils of the invention could be included are, for example, chewing gums, confections and frostings, gelatins and puddings, hard and soft candies, jams and jellies, white granulated sugar, sugar substitutes, sweet sauces, toppings and syrups, and dry-blended powder mixes.

PUFA-Containing Oils for Use in Health Food Products, Medical Foods and Pharmaceuticals A health food product is any food product that imparts a health benefit and include functional foods, medical foods, medical nutritionals and dietary supplements.

A "medical food" is a food administered under the supervision of a physician and intended for the specific dietary management of a disease for which distinctive nutritional requirements are established.

Additionally, the plant/seed oils and altered seed oils of the invention may be used in standard pharmaceutical compositions (e.g., the long-chain PUFA containing oils could readily be incorporated into the any of the above mentioned food products, to thereby produce a functional or medical food). More concentrated formulations comprising PUFAs include capsules, powders, tablets, softgels, gelcaps, liquid concentrates and emulsions which can be used as a dietary supplement in humans or animals other than humans.

Thus, a pharmaceutical composition could comprise one ore more of the fatty acids and/or resulting oils as well as a standard, well-known, non-toxic pharmaceutically acceptable carrier, adjuvant or vehicle such as phosphate buffered slaine, water, ethanol, polyols, vegetable oils, a wetting agent or an emulsion such as a water/oil emulsion. The composition may be in either a liquid or solid form.

Possible routes of administration include oral, rectal, parenteral, topical, etc. The route of administration will depend upon the desired effect.

Dosage to administered to a patient may be determined by one of ordinary skill in the art. Factors to consider include, but are not limited to, patient weight, patient age, immune status of patient, etc.

The composition can be in a variety of forms such as a solution, a dispersion, a suspension, an emulsion or a sterile powder which is then reconstituted. Thus, suspensions, in addition to the active compounds, may contain suspending agents such as ethoxylated isostearyl alcohols, polyoxyethylene sorbiot and sorbitan esters, microcrystalline cellulose, aluminum metahdroxide, bentonite, agar-agar and tragacanth or mixtures of substances, and the like.

Solid dosage forms such as tablets and capsules can be prepared using techniques well known in the art. For example, fatty acids/oils of the invention can be tableted with conventional tablet bases such as lactose, sucrose, and cornstarch in combination with binders such as acacia, cornstarch or gelatin, disintegrating or magnesium stearate. Capsules can be prepared by incorporating these excipients into a gelatin capsule along with antioxidants and desired fatty acid/oil. The terms "dose" and "serving" are used interchangeable herein and refer to the amount of a nutritional or pharmaceutical composition ingested by a patient in a single setting and designed to deliver effective amounts of the desired components.

It is possible that such a composition may be utilized for cosmetic purposes. It may be added to pre-existing cosmetic compositions such that a mixture is formed or may be used as a sole composition.

PUFA-Containing Oils for Use in Animal Feeds and in Veterinary Applications

Animal feeds are generically defined herein as products intended for use as feed or for mixing in feed for animals other than humans. The plant/seed oils and altered seed oils of the invention can be used as an ingredient in various animal feeds.

More specifically, although not limited therein, it is expected that the oils of the invention can be used within pet food products, ruminant and poultry food products and aquacultural food products. Pet food products are those products intended to be fed to a pet (e.g., dog, cat, bird, reptile, rodent). These products can include the cereal and health food products above, as well as meat and meat byproducts, soy protein products, grass and hay products (e.g., alfalfa, timothy, oat or brome grass, vegetables). Ruminant and poultry food products are those wherein the product is intended to be fed to an animal (e.g., turkeys, chickens, cattle, swine). As with the pet foods above, these products can include cereal and health food products, soy protein products, meat and meat byproducts, and grass and hay products as listed above. Aquacultural food products (or "aquafeeds") are those products intended to be used in aquafarming, i.e., which concerns the propagation, cultivation or farming of aquatic organisms and/or animals in fresh or marine waters.

It should be appreciated that the above-described nutritional and pharmaceutical compositions may be utilized in connection with animals since animals may experience may of the same needs and conditions as humans.

EXAMPLES

The present invention is further defined in the following Examples, in which parts and percentages are by weight and degrees are Celsius, unless otherwise stated. It should be understood that these Examples, while indicating preferred embodiments of the invention, are given by way of illustration only. From the above discussion and these Examples, one skilled in the art can ascertain the essential characteristics of this invention, and without departing from the spirit and scope thereof, can make various changes and modifications of the invention to adapt it to various usages and conditions. Thus, various modifications of the invention in addition to those shown and described herein will be apparent to those skilled in the art from the foregoing description. Such modifications are also intended to fall within the scope of the appended claims.

General Methods

Standard recombinant DNA and molecular cloning techniques used in the Examples are well known in the art and are described by: (1) Sambrook, J., Fritsch, E. F. and Maniatis, T. *Molecular Cloning: A Laboratory Manual*; Cold Spring Harbor Laboratory: Cold Spring Harbor, N.Y. (1989) (Maniatis); (2) T. J. Silhavy, M. L. Bennan, and L. W. Enquist, Experiments with Gene Fusions; Cold Spring Harbor Laboratory: Cold Spring Harbor, N.Y. (1984); and (3) Ausubel, F. M. et al., Current Protocols in Molecular Biology, published by Greene Publishing Assoc. and Wiley-Interscience (1987).

Materials and methods suitable for the maintenance and growth of microbial cultures are well known in the art. Techniques suitable for use in the following examples may be found as set out in Manual of Methods for General Bacteriology (Phillipp Gerhardt, R. G. E. Murray, Ralph N. Costilow, Eugene W. Nester, Willis A. Wood, Noel R. Krieg and G. Briggs Phillips, Eds), American Society for Microbiology: Washington, D.C. (1994)); or by Thomas D. Brock in Biotechnology: A Textbook of Industrial Microbiology, $2^{nd}$ ed., Sinauer Associates: Sunderland, Mass. (1989). All reagents, restriction enzymes and materials used for the growth and maintenance of microbial cells were obtained from Aldrich Chemicals (Milwaukee, Wis.), DIFCO Laboratories (Detroit, Mich.), GIBCO/BRL (Gaithersburg, Md.), or Sigma Chemical Company (St. Louis, Mo.), unless otherwise specified.

General molecular cloning was performed according to standard methods (Sambrook et al., supra). DNA sequence was generated on an ABI Automatic sequencer using dye terminator technology (U.S. Pat. No. 5,366,860; EP 272,007) using a combination of vector and insert-specific primers. Sequence editing was performed in Sequencher (Gene Codes Corporation, Ann Arbor, Mich.). All sequences represent coverage at least two times in both directions. Comparisons of genetic sequences were accomplished using DNASTAR software (DNA Star, Inc.).

The meaning of abbreviations is as follows: "sec" means second(s), "min" means minute(s), "h" means hour(s), "d" means day(s), "µL" means microliter(s), "mL" means milliliter(s), "L" means liter(s), "µM" means micromolar, "mM" means millimolar, "M" means molar, "mmol" means millimole(s), "µmole" mean micromole(s), "g" means gram(s), "µg" means microgram(s), "ng" means nanogram(s), "U" means unit(s), "bp" means base pair(s) and "kB" means kilobase(s).

Example 1

Transformation of Somatic Soybean Embryo Cultures with Soybean Expression Vectors Culture Conditions:

Soybean embryogenic suspension cultures (cv. Jack) are maintained in 35 mL liquid medium SB196 (infra) on a rotary shaker, 150 rpm, 26° C. with cool white fluorescent lights on 16:8 h day/night photoperiod at light intensity of 60-85 µE/m2/s. Cultures are subcultured every 7 days to two weeks by inoculating approximately 35 mg of tissue into 35 mL of fresh liquid SB196 (the preferred subculture interval is every 7 days).

Soybean embryogenic suspension cultures are transformed with the soybean expression plasmids by the method of particle gun bombardment (Klein et al., Nature, 327:70

(1987)) using a DuPont Biolistic PDS1000/HE instrument (helium retrofit) for all transformations.

Soybean Embryogenic Suspension Culture Initiation:

Soybean cultures are initiated twice each month with 5-7 days between each initiation. Pods with immature seeds from available soybean plants are picked 45-55 days after planting. Seeds are removed from the pods and placed into a sterilized magenta box. The soybean seeds are sterilized by shaking them for 15 min in a 5% Clorox solution with 1 drop of ivory soap (i.e., 95 mL of autoclaved distilled water plus 5 mL Clorox and 1 drop of soap, mixed well). Seeds are rinsed using 2 1-liter bottles of sterile distilled water and those less than 4 mm are placed on individual microscope slides. The small end of the seed is cut and the cotyledons pressed out of the seed coat. Cotyledons are transferred to plates containing SB1 medium (25-30 cotyledons per plate). Plates are wrapped with fiber tape and are maintained at 26° C. with cool white fluorescent lights on 16:8 h day/night photoperiod at light intensity of 60-80 µE/m2/s for eight weeks, with a media change after 4 weeks. After incubation on SB1 medium, secondary embryos are cut and placed into SB196 liquid media for 7 days.

Preparation of DNA for Bombardment:

Either an intact plasmid or a DNA plasmid fragment containing the genes of interest and the selectable marker gene are used for bombardment. Fragments from soybean expression plasmids, the construction of which is described herein, are obtained by gel isolation of digested plasmids. In each case, 100 µg of plasmid DNA is used in 0.5 mL of the specific enzyme mix described below. Plasmids are digested with AscI (100 units) in NEBuffer 4 (20 mM Tris-acetate, 10 mM magnesium acetate, 50 mM potassium acetate, 1 mM dithiothreitol, pH 7.9), 100 µg/mL BSA, and 5 mM beta-mercaptoethanol at 37° C. for 1.5 h. The resulting DNA fragments are separated by gel electrophoresis on 1% SeaPlaque GTG agarose (BioWhitaker Molecular Applications) and the DNA fragments containing gene cassettes are cut from the agarose gel. DNA is purified from the agarose using the GELase digesting enzyme following the manufacturer's protocol.

A 50 µL aliquot of sterile distilled water containing 3 mg of gold particles (3 mg gold) is added to 30 µL of a 10 ng/µL DNA solution (DNA fragment prepared as described herein), 25 µL 5M $CaCl_2$ and 20 µL of 0.1 M spermidine. The mixture is shaken 3 min on level 3 of a vortex shaker and spun for 10 sec in a bench microfuge. The supernatant is removed, followed by a wash with 400 µL 100% ethanol and another brief centrifugation. The 400 µL ethanol is removed and the pellet is resuspended in 40 µL of 100% ethanol. Five µL of DNA suspension is dispensed to each flying disk of the Biolistic PDS1000/HE instrument disk. Each 5 µL aliquot contains approximately 0.375 mg gold per bombardment (e.g., per disk).

Tissue Preparation and Bombardment with DNA:

Approximately 150-200 mg of seven day old embryogenic suspension cultures is placed in an empty, sterile 60×15 mm petri dish and the dish is covered with plastic mesh. The chamber is evacuated to a vacuum of 27-28 inches of mercury, and tissue is bombarded one or two shots per plate with membrane rupture pressure set at 1100 PSI. Tissue is placed approximately 3.5 inches from the retaining/stopping screen.

Selection of Transformed Embryos:

Transformed embryos are selected using chlorsulfuron (when the acetolactate synthase (ALS) gene is used as the selectable marker).

Following bombardment, the tissue is placed into fresh SB196 media and cultured as described above. Six to eight days post-bombardment, the SB196 is exchanged with fresh SB196 containing 100 ng/mL chlorsulfuron. The selection media is refreshed weekly. Four to six weeks post-selection, green, transformed tissue is observed growing from untransformed, necrotic embryogenic clusters. Isolated, green tissue is removed and inoculated into multiwell plates to generate new, clonally propagated, transformed embryogenic suspension cultures.

Embryo Maturation:

Transformed embryogenic clusters from production transformation are cultured for four-six weeks in multiwell plates as described above at 26° C. in SB196 under cool white fluorescent (Phillips cool white Econowatt F40/CW/RS/EW) and Agro (Phillips F40 Agro) bulbs (40 watt) on a 16:8 h photoperiod with light intensity of 90-120 µE/m$^2$s. After this time embryo clusters are removed to a solid agar media, SB166, for one-two weeks and then subcultured to SB103 medium for 3-4 weeks to mature embryos. After maturation on plates in SB103, individual embryos are removed from the clusters, dried and screened for alterations in their fatty acid compositions as described in Example 2. When desired, plants are obtained from some events as described below.

Embryo Desiccation and Germination:

Matured individual embryos are desiccated by placing them into an empty, small petri dish (60×15 mm) for approximately four-seven days. The plates are sealed with fiber tape (creating a small humidity chamber). Desiccated embryos are planted into SB71-4 medium where they are left to germinate under the same culture conditions described above. Germinated plantlets are removed from germination medium and rinsed thoroughly with water and then planted in Redi-Earth in a 24-cell pack tray, and covered with a clear plastic dome. After one-two weeks the dome is removed and plants hardened off for a further week. If plantlets look hardy they are transplanted to a 10 inch pot of Redi-Earth with up to 3 plantlets per pot. After ten to sixteen weeks, mature seeds are harvested, chipped and analyzed for fatty acids as described herein.

Media Recipes:

| SB 196 - FN Lite Liquid Proliferation Medium (per liter) | |
|---|---|
| MS FeEDTA - 100x Stock 1 | 10 mL |
| MS Sulfate - 100x Stock 2 | 10 mL |
| FN Lite Halides - 100x Stock 3 | 10 mL |
| FN Lite P, B, Mo - 100x Stock 4 | 10 mL |
| B5 vitamins (1 mL/L) | 1.0 mL |
| 2,4-D (10 mg/L final concentration) | 1.0 mL |
| $KNO_3$ | 2.83 gm |
| $(NH_4)_2SO_4$ | 0.463 gm |
| asparagine | 1.0 gm |
| sucrose (1%) | 10 gm |
| pH 5.8 | |

| FN Lite Stock Solutions | | | |
|---|---|---|---|
| Stock Number | | 1000 mL | 500 mL |
| 1 | MS Fe EDTA 100x Stock | | |
| | $Na_2$ EDTA* | 3.724 g | 1.862 g |
| | $FeSO_4$—$7H_2O$ | 2.784 g | 1.392 g |
| 2 | MS Sulfate 100x stock | | |
| | $MgSO_4$—$7H_2O$ | 37.0 g | 18.5 g |
| | $MnSO_4$—$H_2O$ | 1.69 g | 0.845 g |
| | $ZnSO_4$—$7H_2O$ | 0.86 g | 0.43 g |
| | $CuSO_4$—$5H_2O$ | 0.0025 g | 0.00125 g |

-continued

| FN Lite Stock Solutions | | | |
|---|---|---|---|
| Stock Number | | 1000 mL | 500 mL |
| 3 | FN Lite Halides 100x Stock | | |
| | $CaCl_2$—$2H_2O$ | 30.0 g | 15.0 g |
| | KI | 0.083 g | 0.0715 g |
| | $CoCl_2$—$6H_2O$ | 0.0025 g | 0.00125 g |
| 4 | FN Lite P, B, Mo 100x Stock | | |
| | $KH_2PO_4$ | 18.5 g | 9.25 g |
| | $H_3BO_3$ | 0.62 g | 0.31 g |
| | $Na_2MoO_4$—$2H_2O$ | 0.025 g | 0.0125 g |

*Add first, dissolve in dark bottle while stirring

SB1 Solid Medium (Per Liter)

1 package MS salts (Gibco/BRL—Cat. No. 11117-066)
1 mL B5 vitamins 1000× stock
31.5 g glucose
2 mL 2,4-D (20 mg/L final concentration)
pH 5.7
8 g TC agar

SB199 Solid Medium (Per Liter)

1 package MS salts (Gibco/BRL—Cat. No. 11117-066)
1 mL B5 vitamins 1000× stock
30 g Sucrose
4 ml 2,4-D (40 mg/L final concentration)
pH 7.0
2 gm Gelrite

SB 166 Solid Medium (Per Liter)

1 package MS salts (Gibco/BRL—Cat. No. 11117-066)
1 mL B5 vitamins 1000× stock
60 g maltose
750 mg $MgCl_2$ hexahydrate
5 g activated charcoal
pH 5.7
2 g gelrite

SB 103 Solid Medium (Per Liter)

1 package MS salts (Gibco/BRL—Cat. No. 11117-066)
1 mL B5 vitamins 1000× stock
60 g maltose
750 mg MgCl2 hexahydrate
pH 5.7
2 g gelrite

SB 71-4 Solid Medium (Per Liter)

1 bottle Gamborg's B5 salts w/sucrose (Gibco/BRL—Cat. No. 21153-036)
pH 5.7
5 g TC agar

2,4-D Stock

Obtain premade from Phytotech Cat. No. D 295—concentration 1 mg/mL

B5 Vitamins Stock (Per 100 mL)

Store aliquots at −20° C.
10 g myo-inositol
100 mg nicotinic acid
100 mg pyridoxine HCl
1 g thiamine
If the solution does not dissolve quickly enough, apply a low level of heat via the hot stir plate.

| SB 228 - Soybean Histodifferentiation and Maturation (SHaM) (per liter) | |
|---|---|
| DDI $H_2O$ | 600 mL |
| FN-Lite Macro Salts for SHaM 10X | 100 mL |
| MS Micro Salts 1000x | 1 mL |
| MS FeEDTA 100x | 10 mL |
| CaCl 100x | 6.82 mL |
| B5 Vitamins 1000x | 1 mL |
| L-Methionine | 0.149 g |
| Sucrose | 30 g |
| Sorbitol | 30 g |

Adjust volume to 900 mL
pH 5.8
Autoclave
Add to cooled media (≦30° C.):
*Glutamine (final concentration 30 mM) 4% 110 mL
*Note:
Final volume will be 1010 mL after glutamine addition. Since glutamine degrades relatively rapidly, it may be preferable to add immediately prior to using media. Expiration 2 weeks after glutamine is added; base media can be kept longer w/o glutamine.

| FN-lite Macro for SHAM 10X- Stock #1 (per liter) | |
|---|---|
| $(NH_4)2SO_4$ (ammonium sulfate) | 4.63 g |
| $KNO_3$ (potassium nitrate) | 28.3 g |
| $MgSO_4*7H_2O$ (magnesium sulfate heptahydrate) | 3.7 g |
| $KH_2PO_4$ (potassium phosphate, monobasic) | 1.85 g |

Bring to volume
Autoclave

| MS Micro 1000X - Stock #2 (per 1 liter) | |
|---|---|
| $H_3BO_3$ (boric acid) | 6.2 g |
| $MnSO_4*H_2O$ (manganese sulfate monohydrate) | 16.9 g |
| $ZnSO_4*7H20$ (zinc sulfate heptahydrate) | 8.6 g |
| $Na_2MoO_4*2H20$ (sodium molybdate dihydrate) | 0.25 g |
| $CuSO_4*5H_2O$ (copper sulfate pentahydrate) | 0.025 g |
| $CoCl_2*6H_2O$ (cobalt chloride hexahydrate) | 0.025 g |
| KI (potassium iodide) | 0.8300 g |

Bring to volume
Autoclave

| FeEDTA 100X - Stock #3 (per liter) | |
|---|---|
| $Na_2EDTA$* (sodium EDTA) | 3.73 g |
| $FeSO_4*7H_2O$ (iron sulfate heptahydrate) | 2.78 g |

*EDTA must be completely dissolved before adding iron.
Bring to Volume
Solution is photosensitive. Bottle(s) should be wrapped in foil to omit light.
Autoclave

| Ca 100X - Stock #4 (per liter) | |
| --- | --- |
| CaCl$_2$*2H$_2$0 (calcium chloride dihydrate) | 44 g |

Bring to Volume
Autoclave

| B5 Vitamin 1000X - Stock #5 (per liter) | |
| --- | --- |
| Thiamine*HCl | 10 g |
| Nicotinic Acid | 1 g |
| Pyridoxine*HCl | 1 g |
| Myo-Inositol | 100 g |

Bring to Volume
Store frozen

| 4% Glutamine - Stock #6 (per liter) | |
| --- | --- |
| DDI water heated to 30° C. | 900 mL |
| L-Glutamine | 40 g |

Gradually add while stirring and applying low heat.
Do not exceed 35° C.
Bring to Volume
Filter Sterilize
Store frozen*
*Note:
Warm thawed stock in 31° C. bath to fully dissolve crystals.

Chlorsulfuron Stock 1 mg/mL in 0.01 N Ammonium Hydroxide

Example 2

Fatty Acid Analysis of Somatic Soybean Embryos and Soybean Seeds

Mature somatic soybean embryos are a good model for zygotic embryos. While in the globular embryo state in liquid culture, somatic soybean embryos contain very low amounts of triacylglycerol or storage proteins typical of maturing, zygotic soybean embryos. At this developmental stage, the ratio of total triacylglyceride to total polar lipid (phospholipids and glycolipid) is about 1:4, as is typical of zygotic soybean embryos at the developmental stage from which the somatic embryo culture was initiated. At the globular stage as well, the mRNAs for the prominent seed proteins, α'-subunit of β-conglycinin, kunitz trypsin inhibitor 3, and seed lectin are essentially absent. Upon transfer to hormone-free media to allow differentiation to the maturing somatic embryo state, triacylglycerol becomes the most abundant lipid class. As well, mRNAs for α'-subunit of β-conglycinin, kunitz trypsin inhibitor 3 and seed lectin become very abundant messages in the total mRNA population. On this basis, the somatic soybean embryo system behaves very similarly to maturing zygotic soybean embryos in vivo, and is thus a good and rapid model system for analyzing the phenotypic effects of modifying the expression of genes in the fatty acid biosynthesis pathway (see PCT Publication No. WO 02/00904). Most importantly, the model system is also predictive of the fatty acid composition of seeds from plants derived from transgenic embryos.

Soybean embryogenic suspension culture (cv. Jack) are transformed as described in Example 1. A subset of soybean embryos generated from each event (ten embryos per event) are harvested, picked into glass GC vials and fatty acid methyl esters are prepared by transesterification. For transesterification, 50 µL of trimethylsulfonium hydroxide (TMSH) and 0.5 mL of hexane are added to the embryos in glass vials and incubated for 30 min at room temperature while shaking. Fatty acid methyl esters (5 µL injected from hexane layer) are separated and quantified using a Hewlett-Packard 6890 Gas Chromatograph fitted with an Omegawax 320 fused silica capillary column (Catalog #24152, Supelco Inc.). The oven temperature is programmed to hold at 220° C. for 2.6 min, increase to 240° C. at 20° C./min and then hold for an additional 2.4 min. Carrier gas is supplied by a Whatman hydrogen generator. Retention times are compared to those for methyl esters of standards commercially available (Nu-Chek Prep, Inc.).

Fatty acids are identified as 16:0 (palmitate), 18:0 (stearic acid), 18:1 (oleic acid), LA, 18:2 (5,9), GLA, ALA, STA, 20:0 (eicosanoic acid), 20:1 (11), 20:2 (7,11) or 20:2 (8,11), EDA, SCI, DGLA, ARA, ERA, JUN, ETA, EPA and DPA; and, fatty acid compositions are expressed as a weight percent (wt. %) of total fatty acids.

In the same way, seeds are harvested and a small chip is taken from part of each seed (from directly opposite the embryonic axis) using a razor blade. The seed chips are analyzed for fatty acids as described above. Seed names are designated by a five number series separated by hyphens where the first three numbers indicate a particular event, the fourth number indicates the plant and the fifth number indicates the seed analyzed.

Example 3

Euglena gracilis Growth, cDNA Synthesis and Library Construction

Euglena gracilis was obtained from Dr. Richard Triemer's lab at Michigan State University (East Lansing, Mich.). From 10 mL of actively growing culture, a 1 mL aliquot was transferred into 250 mL of Euglena gracilis (Eg) Medium in a 500 mL glass bottle. Eg medium was made by combining 1 g of sodium acetate, 1 g of beef extract (U126-01, Difco Laboratories, Detroit, Mich.), 2 g of Bacto® tryptone (0123-17-3, Difco Laboratories), 2 g of Bacto® yeast extract (0127-17-9, Difco Laboratories) in 970 mL of water. After filter sterilizing, 30 mL of soil-water supernatant (15-3790, Carolina Biological Supply Company, Burlington, N.C.) was aseptically added to give the final Eg medium. Euglena gracilis cultures were grown at 23° C. with a 16 h light, 8 h dark cycle for 2 weeks with no agitation.

After 2 weeks, 10 mL of culture was removed for lipid analysis and centrifuged at 1,800×g for 5 min. The pellet was washed once with water and re-centrifuged. The resulting pellet was dried for 5 min under vacuum, resuspended in 100 µL of trimethylsulfonium hydroxide (TMSH) and incubated at room temperature for 15 min with shaking. After this, 0.5 mL of hexane was added and the vials were incubated for 15 min at room temperature with shaking. Fatty acid methyl esters (5 µL injected from hexane layer) were separated and quantified using a Hewlett-Packard 6890 Gas Chromatograph fitted with an Omegawax 320 fused silica capillary column (Supelco Inc., Cat. No. 24152). The oven temperature was programmed to hold at 220° C. for 2.7 min, increase to 240° C. at 20° C./min and then hold for an additional 2.3 min. Carrier gas was supplied by a Whatman hydrogen generator.

Figure 13:
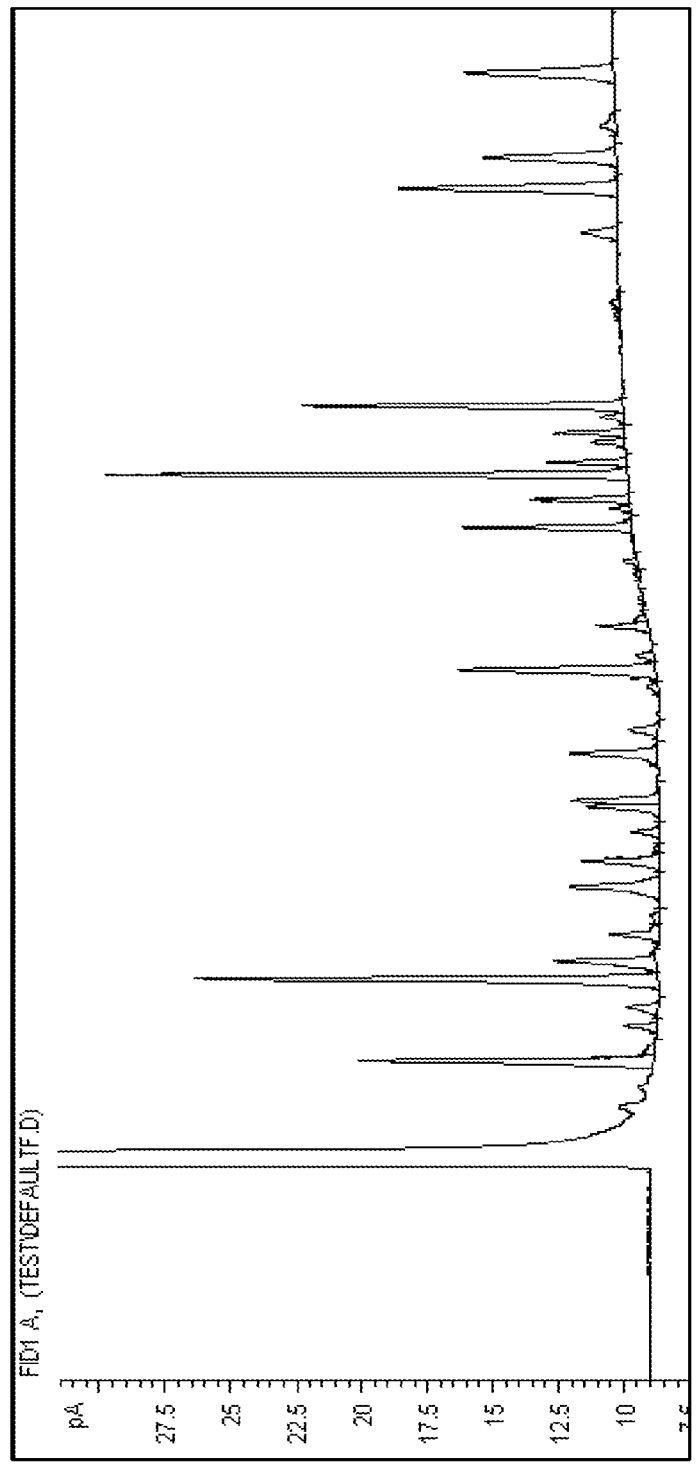
FIG. 13 shows a chromatogram of the lipid profile of an *Euglena gracilis* cell extract as described in the Examples.

Retention times were compared to those for methyl esters of standards commercially available (Nu-Chek Prep, Inc. Cat. No. U-99-A) and the resulting chromatogram is shown in FIG. 13.

The remaining 2 week culture (240 mL) was pelleted by centrifugation at 1,800×g for 10 min, washed once with water and re-centrifuged. Total RNA was extracted from the resulting pellet using the RNA STAT-60™ reagent (TEL-TEST, Inc., Friendswood, Tex.) and following the manufacturer's protocol provided (use 5 mL of reagent, dissolved RNA in 0.5 mL of water). In this way, 1 mg of total RNA (2 mg/mL) was obtained from the pellet. The mRNA was isolated from 1 mg of total RNA using the mRNA Purification Kit (Amersham Biosciences, Piscataway, N.J.) following the manufacturer's protocol provided. In this way, 85 μg of mRNA was obtained.

A cDNA library was generated using the Cloneminer™ cDNA Library Construction Kit (Cat. No. 18249-029, Invitrogen Corporation, Carlsbad, Calif.) and following the manufacturer's protocol provided (Version B, 25-0608). Using the non-radiolabeling method, cDNA was synthesized from 3.2 μg of mRNA (described above) using the Biotin-attB2-Oligo (dT) primer. After synthesis of the first and second strand, the attB1 adapter was added, ligated and the cDNA was size fractionated using column chromatography. DNA from fractions 7 and 8 (size ranging from ~800-1500 bp) were concentrated, recombined into pDONR™222 and transformed into *E. coli* ElectroMAX™ DH10B™ T1 Phage-Resistant cells (Invitrogen Corporation). The *Euglena gracilis* library was named eeg1c.

Example 4

Construction of Soybean Expression Vector pKR1084 for Co-Expression of the *Euglena gracilis* Delta-9 Elongase and the *Mortierella alpina* Delta-5 Desaturase The NotI fragment of pKS129 (SEQ ID NO:1; which is described in PCT Publication No. WO 04/071467), containing the MaD5 (SEQ ID NO:52) was cloned into the NotI site of pKR457 (SEQ ID NO:2; which is described in PCT Publication No. WO 05/047479), to give pKR606 (SEQ ID NO:3).

Vector pKR606 (SEQ ID NO:3) was digested with BsiWI and after filling to blunt the ends, the fragment containing the Gy1/MaD5/legA2 cassette was cloned into the filled NgoMI site of pKR277 (SEQ ID NO:4; which is described in PCT Publication No. WO 04/071467) to produce pKR804 (SEQ ID NO:5).

A clone from the *Euglena* cDNA library (eeg1c; see Example 3), called eeg1c.pk001.n5.f, containing the *Euglena gracilis* delta-9 elongase (EgD9elo; SEQ ID NO:46; see also U.S. application Ser. No. 11/601,563 (filed Nov. 16, 2006, which published May 24, 2007)) was used as template to amplify EgD9elo with oligonucleotide primers oEugEL1-1 (SEQ ID NO:42) and oEugEL1-2 (SEQ ID NO:43) using the VentR® DNA Polymerase (Cat. No. M0254S, New England Biolabs Inc., Beverly, Mass.) following the manufacturer's protocol. The resulting DNA fragment was cloned into the pCR-Blunt® cloning vector using the Zero Blunt® PCR Cloning Kit (Invitrogen Corporation), following the manufacturer's protocol, to produce pKR906 (SEQ ID NO:45).

Plasmid pKR906 (SEQ ID NO:45) was digested with NotI and the fragment containing the EgD9elo was cloned into plasmid pKR132 (SEQ ID NO:12; which is described in PCT Publication No. WO 2004/071467) to give pKR953 (SEQ ID NO:6).

Figure 2:
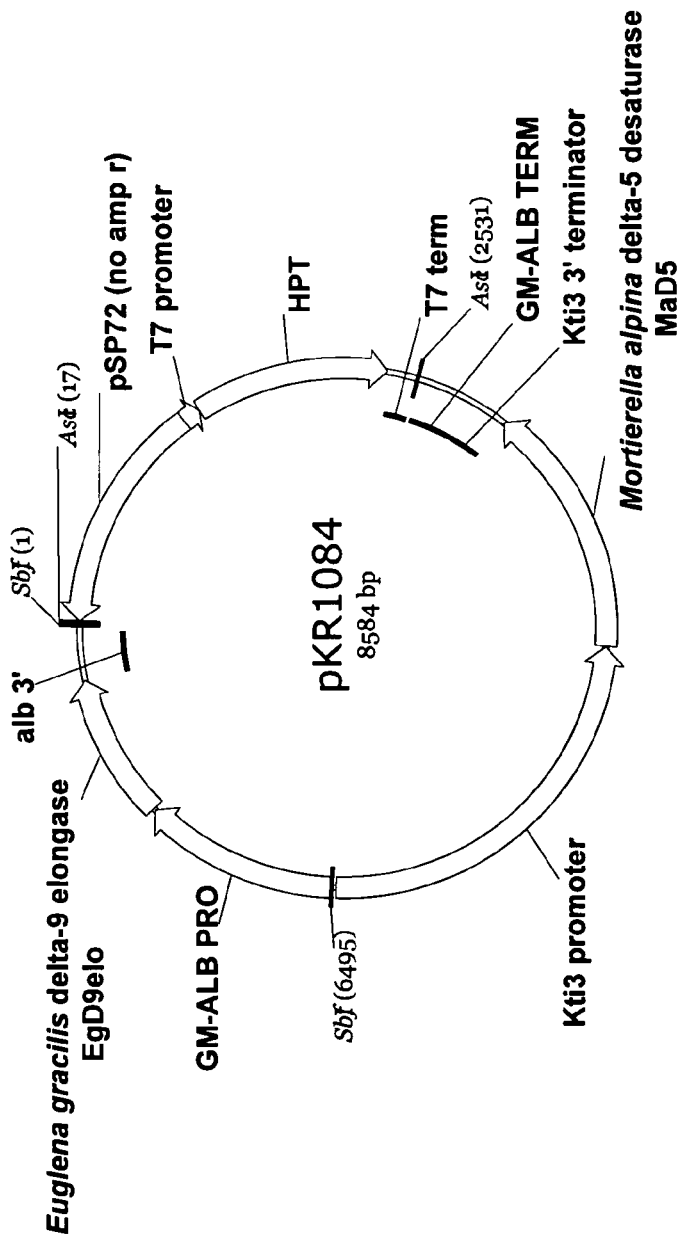
FIG. 2 is a map of plasmid pKR1084 (see also SEQ ID NO:7).

Plasmid pKR953 (SEQ ID NO:6) was digested with PstI and the fragment containing the EgD9elo was cloned into the SbfI site of pKR804 (SEQ ID NO:5) to give pKR1084 (SEQ ID NO:7; FIG. 2).

In this way, the *Mortierella alpina* delta-5 desaturase (MaD5) was expressed with the *Euglena gracilis* delta-9 elongase (EgD9elo) behind strong, seed-specific promoters.

Example 5

*Tetruetreptia pomquetensis* CCMP1491 Growth, cDNA Synthesis and Delta-8 Desaturase Cloning

*Tetruetreptia pomquetensis* CCMP1491 cells (from 1 liter of culture) was purchased from the Provasoli-Guillard National Center for Culture of Marine Phytoplakton (CCMP) (Bigelow Laboratory for Ocean Sciences, West Boothbay Harbor, Me.). Total RNA was isolated using the trizol reagent (Invitrogen, Carlsbad, Calif.), according to the manufacturer's protocol. The cell pellet was resuspended in 0.75 mL of trizol reagent, mixed with 0.5 mL of 0.5 mm glass beads, and homogenized in a Biospec mini beadbeater (Bartlesville, Okla.) at the highest setting for 3 min. The mixture was centrifuged in an Eppendorf centrifuge for 30 sec at 14,000 rpm to remove debris and glass beads. Supernatant was extracted with 150 μL of 24:1 chloroform:isoamyl alcohol. The upper aqueous phase was used for RNA isolation.

For RNA isolation, the aqueous phase was mixed with 0.375 mL of isopropyl alcohol and allowed to incubate at room temperature for 5 min. Precipitated RNA was collected by centrifugation at 8,000 rpm and 4° C. for 5 min. The pellet was washed once with 0.7 mL of 80% ethanol and air dried. Thus, 95 μg of total RNA was obtained from *Tetruetreptia pomquetensis* CCMP1491.

Total RNA (0.95 μg of total RNA in 1 μL) was used as template to synthesize double stranded cDNA. The Creator™ SMART™ cDNA Library Construction Kit from BD Bioscience Clontech (Palo Alto, Calif.) was used. Total RNA (1 μL) was mixed with 1 μL of SMART IV oligonucleotide (SEQ ID NO:60), 1 μL of the Adaptor Primer from Invitrogen 3'-RACE kit (SEQ ID NO:61) and 2 μL of water. The mixture was heated to 75° C. for 5 min and then cooled on ice for 5 min. To the mixture was added, 2 μL of 5× first strand buffer, 1 μL 20 mM DTT, 1 μL of dNTP mix (10 mM each of dATP, dCTP, dGTP and dTTP) and 1 μL of PowerScript reverse transcriptase. The sample was incubated at 42° C. for 1 h. The resulting first strand cDNAs were then used as template for amplification.

The *Tetruetreptia pomquetensis* CCMP1491 (TpomD8; SEQ ID NO:50; see also Applicants' Assignee's co-pending application having U.S. patent application Ser. No. 11/876, 115 (filed Oct. 22, 2007)) was amplified from the cDNA with oligonucleotide primers TpomNot-5 (SEQ ID NO:62) and TpomNot-3 (SEQ ID NO:63) using Taq polymerase (Invitrogen Corporation) following the manufacturer's protocol.

*Tetruetreptia pomquetensis* CCMP1491 cDNA (1 μL) was combined with 50 pmol of TpomNot-5 (SEQ ID NO:62), 50 pmol of TpomNot-3 (SEQ ID NO:63), 1 μL of PCR nucleotide mix (10 mM, Promega, Madison, Wis.), 5 μL of 10×PCR buffer (Invitrogen Corporation), 1.5 μL of MgCl$_2$ (50 mM, Invitrogen Corporation), 0.5 μL of Taq polymerase (Invitrogen Corporation) and water to 50 μL. The reaction conditions were 94° C. for 3 min followed by 35 cycles of 94° C. for 45 sec, 55° C. for 45 sec and 72° C. for 1 min. The PCR was finished at 72° C. for 7 min and then held at 4° C. The PCR reaction was analyzed by agarose gel electrophoresis on 5 µL and a DNA band with molecular weight around 1.3 kb was observed.

The remaining 45 µL of product was separated by agarose gel electrophoresis and the DNA purified using the Zymoclean™ Gel DNA Recovery Kit (Zymo Research, Orange, Calif.) following the manufacturer's protocol. The resulting DNA was cloned into the pGEM®-T Easy Vector (Promega) following the manufacturer's protocol to give pLF114-10 (SEQ ID NO:64).

Example 6

Construction of Soybean Expression Vectors for Expression of the *Tetruetreptia pomquetensis* CCMP1491 Delta-8 Desaturase The PstI fragment, containing the Ann/SdD17/BD30 cassette from pKR271 (SEQ ID NO:65; which is described in PCT Publication No. WO 04/071467) is cloned into the SbfI site of pKR226 (SEQ ID NO:9; which is also described in PCT Publication No. WO 04/071467) to produce vector pKR886r (SEQ ID NO:66).

A starting plasmid pKR72 (ATCC Accession No. PTA-6019; SEQ ID NO:67, 7085 bp sequence), a derivative of pKS123 which was previously described in PCT Publication No. WO 02/008269, contains the hygromycin B phosphotransferase gene (HPT) (Gritz, L. and Davies, J., *Gene* 25:179-188 (1983)), flanked by the T7 promoter and transcription terminator (T7prom/HPT/T7term cassette), and a bacterial origin of replication (ori) for selection and replication in bacteria (e.g., *E. coli*). In addition, pKR72 also contains HPT, flanked by the 35S promoter (Odell et al., *Nature* 313:810-812 (1985)) and NOS 3' transcription terminator (Depicker et al., *J. Mol. Appl. Genet.* 1:561-570 (1982)) (35S/HPT/NOS3' cassette) for selection in plants such as soybean. pKR72 also contains a NotI restriction site, flanked by the promoter for the α' subunit of β-conglycinin (Beachy et al., *EMBO J.* 4:3047-3053 (1985)) and the 3' transcription termination region of the phaseolin gene (Doyle et al., *J. Biol. Chem.* 261:9228-9238 (1986)), thus allowing for strong tissue-specific expression in the seeds of soybean of genes cloned into the NotI site.

The βcon/NotI/Phas3' cassette in plasmid pKR72 (SEQ ID NO:67) is amplified using oligonucleotide primers oCon-1 (SEQ ID NO:68 and oCon-2 (SEQ ID NO:69) using the VentR® DNA Polymerase (Catalog No. M0254S, New England Biolabs Inc., Beverly, Mass.) following the manufacturer's protocol. The resulting DNA fragment is digested with XbaI and cloned into the XbaI site of pUC19, to produce pKR179 (SEQ ID NO:24).

TpomD8 is released from plasmid pLF114-10 (SEQ ID NO:64; see Example 5) by digestion with NotI and is cloned into the NotI site of plasmid pKR179 (SEQ ID NO:24) to produce pKR1002 (SEQ ID NO:8).

Figure 3:
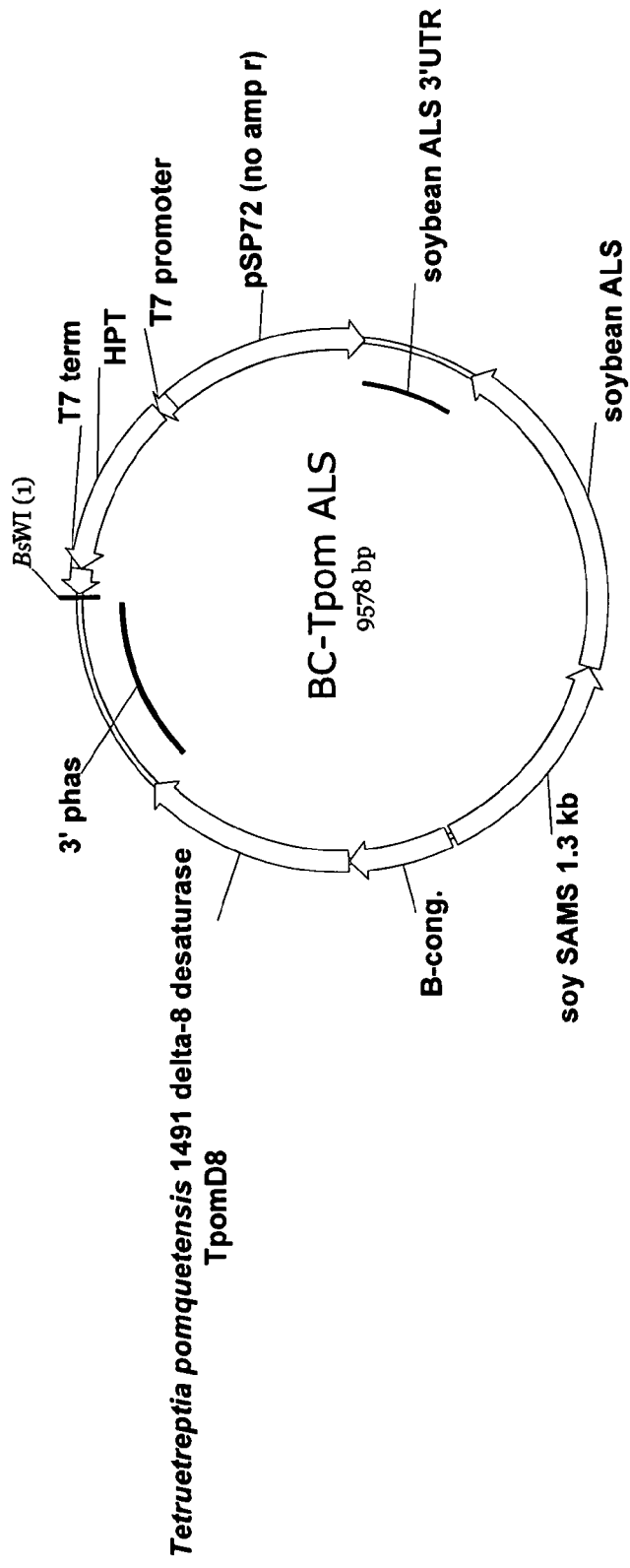
FIG. 3 is a map of plasmid BC-Tpom_ALS (see also SEQ ID NO:10).
Figure 4:
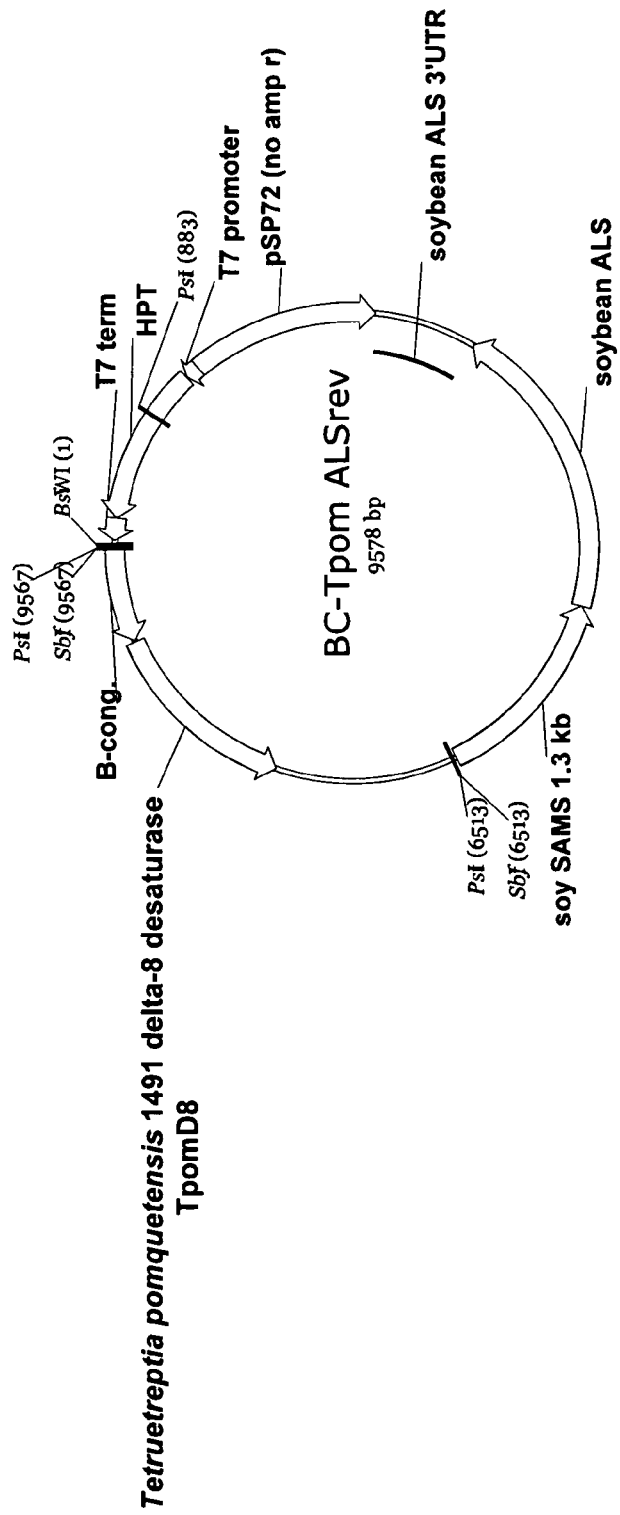
FIG. 4 is a map of plasmid BC-Tpom_ALSrev (see also SEQ ID NO:11).

Vector pKR1002 (SEQ ID NO:8) is digested with PstI and the fragment containing the TpomD8 (SEQ ID NO:50) is cloned into the SbfI site of pKR226 (SEQ ID NO:9; which is described in PCT Publication No. WO 04/071467)) to give BC-Tpom_ALS (SEQ ID NO:10; FIG. 3) or BC-Tpom_ALSrev (SEQ ID NO:11; FIG. 4), depending on the orientation.

In this way, the *Tetruetreptia pomquetensis* CCMP1491 delta-8 desaturase (TpomD8) can be expressed behind a strong, seed specific promoter in a soybean expression vector having the ALS herbicide resistance marker and no *Saprolegnia diclina* delta-17 desaturase (SdD17) and/or no *Fusarium moniliforme* delta-15 desaturase (FmD15).

Example 7

Construction of Soybean Expression Vectors for Expression of the *Tetruetreptia pomquetensis* CCMP1491 Delta-8 Desaturase with the *Euglena gracilis* Delta-5 Desaturase A clone from the *Euglena* cDNA library (eeg1c; the construction of which is described in Example 3), called eeg1c.pk016.n9.f, containing the *Euglena gracilis* delta-5 desaturase (EgD5; SEQ ID NO:54; Applicants' Assignee's co-pending application having U.S. patent application Ser. No. 11/748,629 (filed May 15, 2007, which published Dec. 20, 2007)) is used as template to amplify EgD5 with oligonucleotide primers EgD5-5Not (SEQ ID NO:13) and EgD5-3Not (SEQ ID NO:14) using the VentR® DNA Polymerase (Cat. No. M0254S, New England Biolabs Inc., Beverly, Mass.) following the manufacturer's protocol. The resulting DNA fragment is digested with NotI and cloned into the NotI site of pKR268 (SEQ ID NO:15; which is described in PCT Publication No. WO 04/071467) to give Ann-EgD5 (SEQ ID NO:16).

Figure 5:
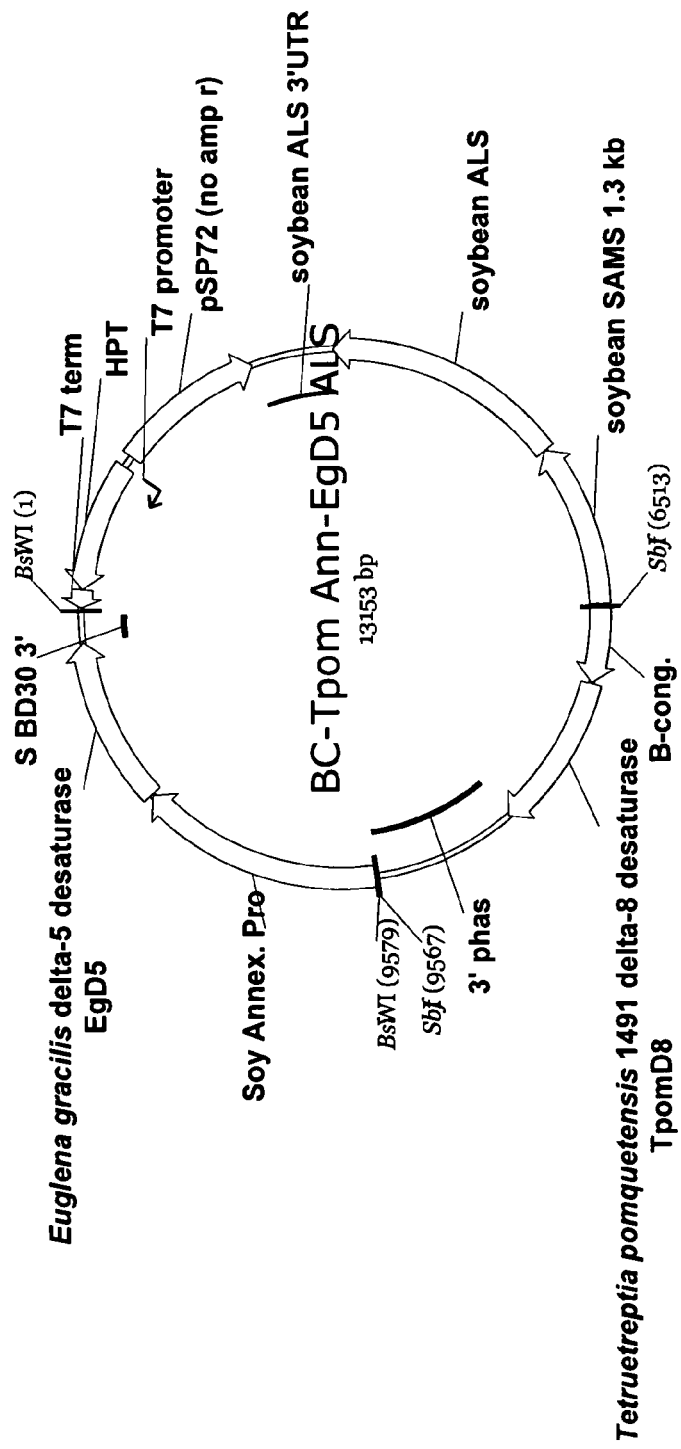
FIG. 5 is a map of plasmid BC-Tpom_Ann-EgD5_ALS (see also SEQ ID NO:17).
Figure 6:
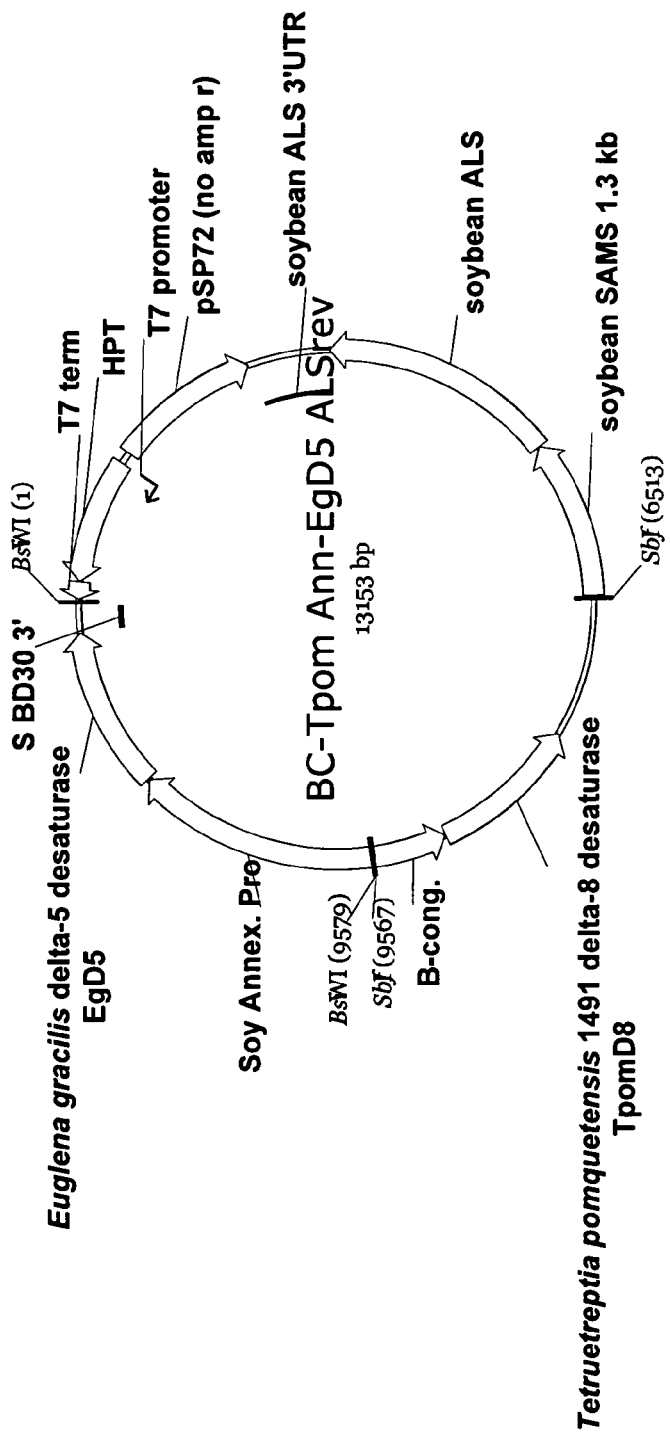
FIG. 6 is a map of plasmid BC-Tpom_Ann-EgD5_ALSrev (see also SEQ ID NO:18).

Ann-EgD5 (SEQ ID NO:16) is digested with BsiWI and cloned into the BsiWI site of BC-Tpom_ALS (SEQ ID NO:10) or BC-Tpom_ALSrev (SEQ ID NO:11) to give BC-Tpom_Ann-EgD5_ALS (SEQ ID NO:17; FIG. 5) or BC-Tpom_Ann-EgD5_ALSrev (SEQ ID NO:18; FIG. 6), respectively.

Example 8

Construction of Soybean Expression Vector KS263 for Down-Regulating Soybean Fad3 Using ELVISLIVES Complementary Regions Soybean expression vector KS133 (SEQ ID NO:19), as described in EP1297163 A2 (PCT Publication No. WO 02/000904, which published Jan. 3, 2002) (the contents of which are hereby incorporated by reference), contains 2× copies of the ELVISLIVES complementary regions flanking a NotI site. The ELVISLIVES sites are flanked by the KTi promoter and the KTi 3' termination sequences.

Figure 7:
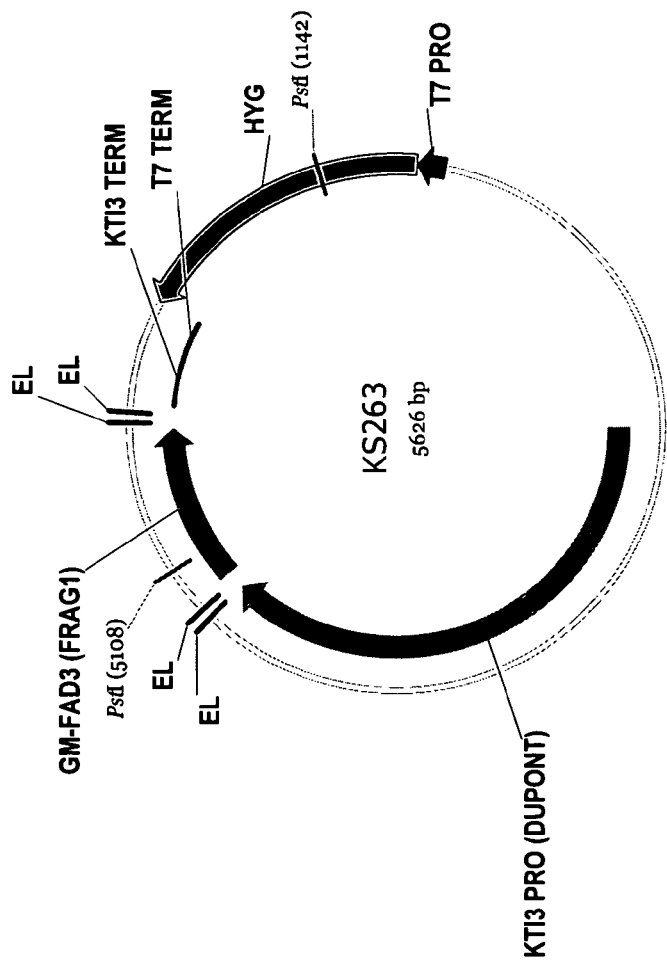
FIG. 7 is a map of plasmid KS263 (see also SEQ ID NO:20).

Plasmid XF1, described in PCT Publication No. WO 93/11245 (which was published on Jun. 10, 1993; also U.S. Pat. No. 5,952,544) (the contents of which are hereby incorporated by reference), contains the soybean delta-15 desaturase (fad3) gene (GenBank Accession No. L22964; also called GmFAD3B). Plasmid XF1 was digested with HhaI and the ends were blunted using 3'→5' exonuclease. The resulting DNA was then digested with EcoRI and then filled. The DNA fragment containing the interior region of the soybean delta-15 desaturase was then ligated into the filled NotI site of KS133 to give KS263 (SEQ ID NO:20; FIG. 7). In this way, a region of the soybean delta-15 desaturase, flanked by ELVISLIVES complementary regions, can be expressed behind the strong seed-specific KTi (also referred to as KTi3) promoter.

Example 9

Construction of Soybean Expression Vectors for Down-Regulating Soybean Fad3 Using ELVISLIVES Complementary Regions The ELVISLIVES/fad3 cassette from KS263 (SEQ ID NO:20) is amplified using ELfad3-5Not (SEQ ID NO:21) and ELfad3-3Not (SEQ ID NO:22) to give a DNA fragment called ELfad3Not (SEQ ID NO:23). PCR is carried out using multiple annealing temperatures ranging from 45° C. to 72° C. with concentrations of DMSO ranging from 0 to 10%. PCR products are sequenced to ensure the desired fragment is obtained.

ELfad3Not DNA fragment (SEQ ID NO:23) is digested with NotI and is cloned into the NotI site of plasmid pKR179 (SEQ ID NO:24) to produce BC-ELfad3 (SEQ ID NO:25).

Figure 8:
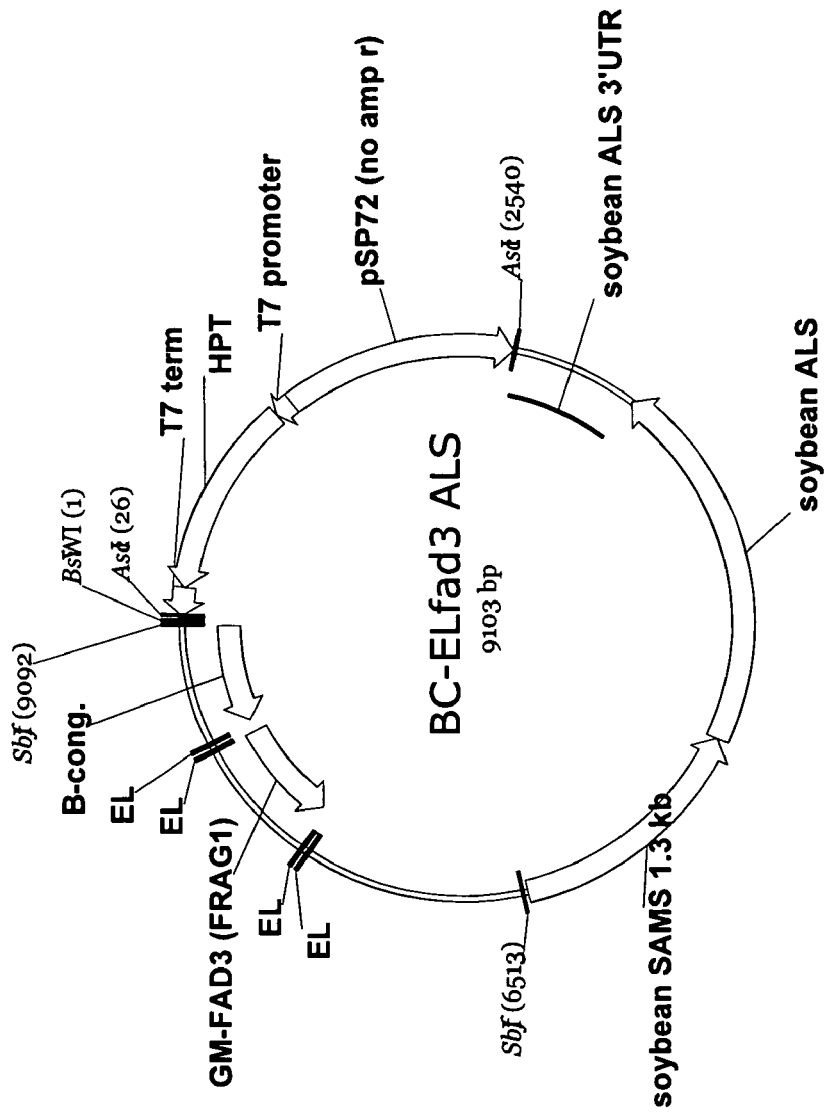
FIG. 8 is a map of plasmid BC-ELfad3_ALS (see also SEQ ID NO:27).

Vector BC-ELfad3 (SEQ ID NO:25) is digested with SbfI and the fragment containing the ELfad3Not DNA fragment is cloned into the SbfI site of pKR226 (SEQ ID NO:9) to produce BC-ELfad3_ALS (SEQ ID NO:27). A schematic depiction of BC-ELfad3_ALS (SEQ ID NO:27) is shown in FIG. 8. In this way, a region of the soybean delta-15 desaturase, flanked by ELVISLIVES complementary regions, can be expressed behind the strong seed-specific beta-conglycinin promoter.

Example 10

Construction of Soybean Expression Vectors for Down-Regulating Soybean Fad3 Using ELVISLIVES Complementary Regions and Co-Expression with the *Tetruetreptia pomquetensis* CCMP1491 Delta-8 Desaturase In a similar construction to that described above, ELfad3Not DNA fragment (SEQ ID NO:23) is digested with NotI and is cloned into the NotI site of pKR268 (SEQ ID NO:15; Example 7) to produce Ann-ELfad3 (SEQ ID NO:28).

Figure 9:
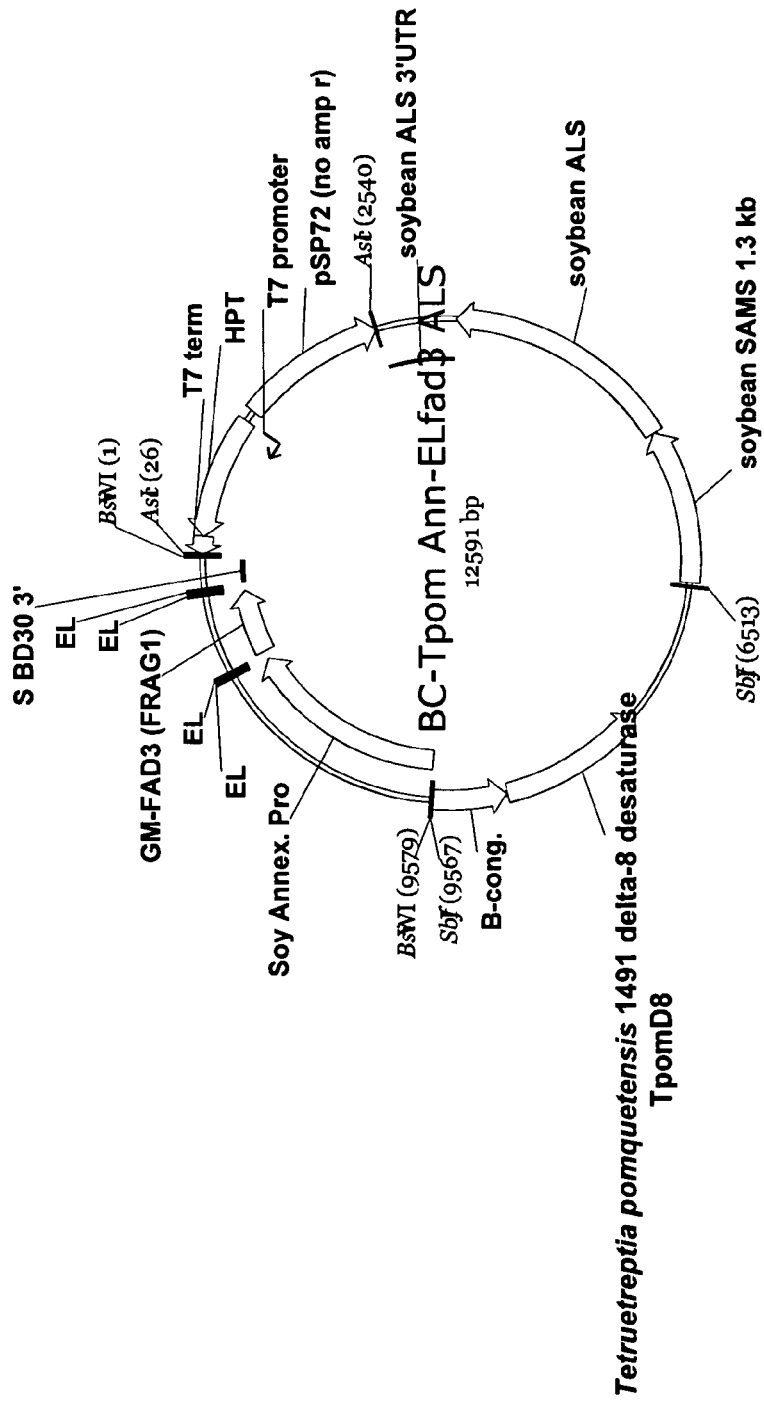
FIG. 9 is a map of plasmid BC-Tpom_Ann-ELfad3_ALS (see also SEQ ID NO:29).

Ann-ELfad3 is digested with BsiWI and cloned into the BsiWI site of BC-Tpom_ALSrev (SEQ ID NO:11; FIG. 4) to give BC-Tpom_Ann-ELfad3_ALS (SEQ ID NO:29; FIG. 9). In this way, a region of the soybean delta-15 desaturase, flanked by ELVISLIVES complementary regions, can be expressed behind the strong seed-specific annexin promoter and co-expressed with the TpomD8.

Example 11

Construction of Soybean Expression Vectors for Down-Regulating Soybean Fad3 Using Fad3 Inverted Repeats A portion of the 5' end of the fad3 gene is amplified from XF1 (described in Example 8) using HPfad3-1 (SEQ ID NO:30) and HPfad3-2 (SEQ ID NO:31) to give a DNA fragment called HPfad3AB (SEQ ID NO:32).

A portion of the 3' end of the fad3 gene is amplified from XF1 (described above) using HPfad3-3 (SEQ ID NO:33) and HPfad3-4 (SEQ ID NO:34) to give a DNA fragment called HPfad3A' (SEQ ID NO:35).

HPfad3AB and HPfad3A' are combined and amplified with HPfad3-1 (SEQ ID NO:30) and HPfad3-4 (SEQ ID NO:34) to give HPfad3ABA' (SEQ ID NO:36).

HPfad3ABA' is digested with NotI/Asp718 and is cloned into the NotI/Asp718 site fragment of plasmid pKR179 (SEQ ID NO:24), containing the beta-conglycinin promoter, to produce BC-HPfad3ABA' (SEQ ID NO:37). The expression cassette generated does not contain a transcription terminator.

Figure 10:
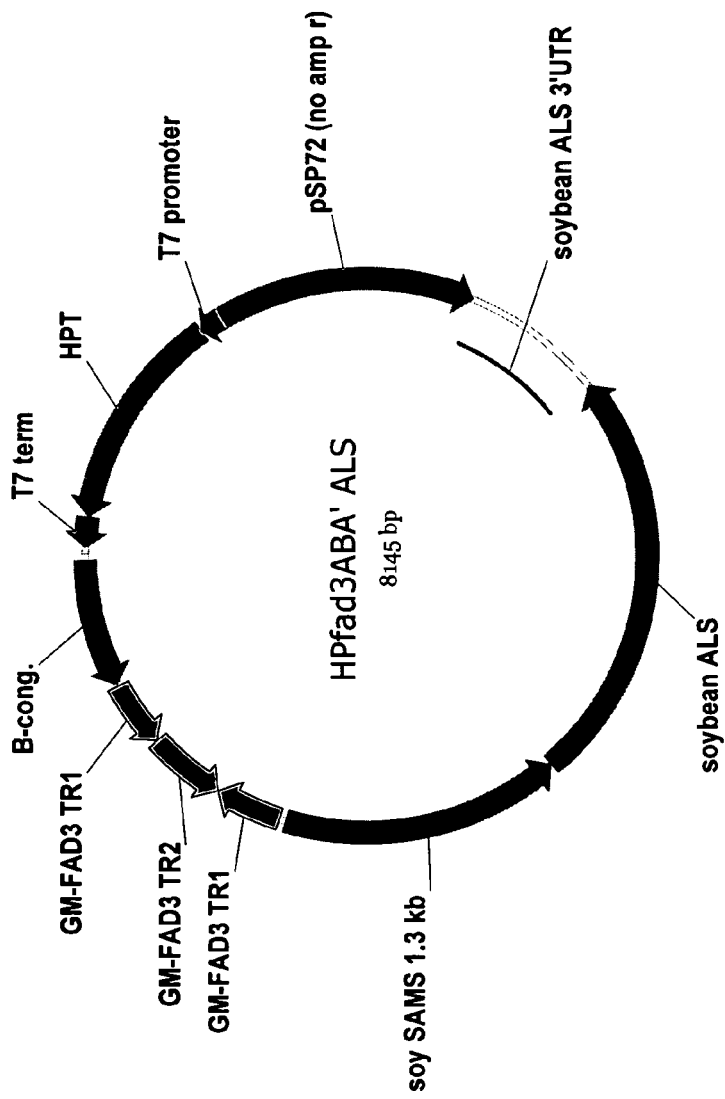
FIG. 10 is a map of plasmids HPfad3ABA'_ALS (see also SEQ ID NO:39).

Vector BC-HPfad3ABA' (SEQ ID NO:37) is digested with SbfI and the fragment containing the HPfad3ABA' DNA fragment is cloned into the SbfI site of pKR226 (SEQ ID NO:9) to produce BC-HPfad3ABA'_ALS (SEQ ID NO:39). A schematic depiction of BC-HPfad3ABA'_ALS (SEQ ID NO:39) is shown in FIG. 10. In this way, a region of the soybean delta-15 desaturase that forms a hairpin structure can be expressed behind the strong seed-specific beta-conglycinin promoter.

Example 12

Construction of Soybean Expression Vectors for Down-Regulating Soybean Fad3 Using Fad3 Hairpins and Co-Expression with the *Tetruetreptia pomquetensis* CCMP1491 Delta-8 Desaturase In a similar construction to that described in Example 11, HPfad3ABA' (SEQ ID NO:36) is digested with NotI/Asp718 and is cloned into the NotI/Asp718 site fragment of plasmid pKR268 (SEQ ID NO:15), containing soy annexin promoter, to produce Ann-HPfad3ABA' (SEQ ID NO:38). The expression cassette generated does not contain a transcription terminator.

Figure 11:
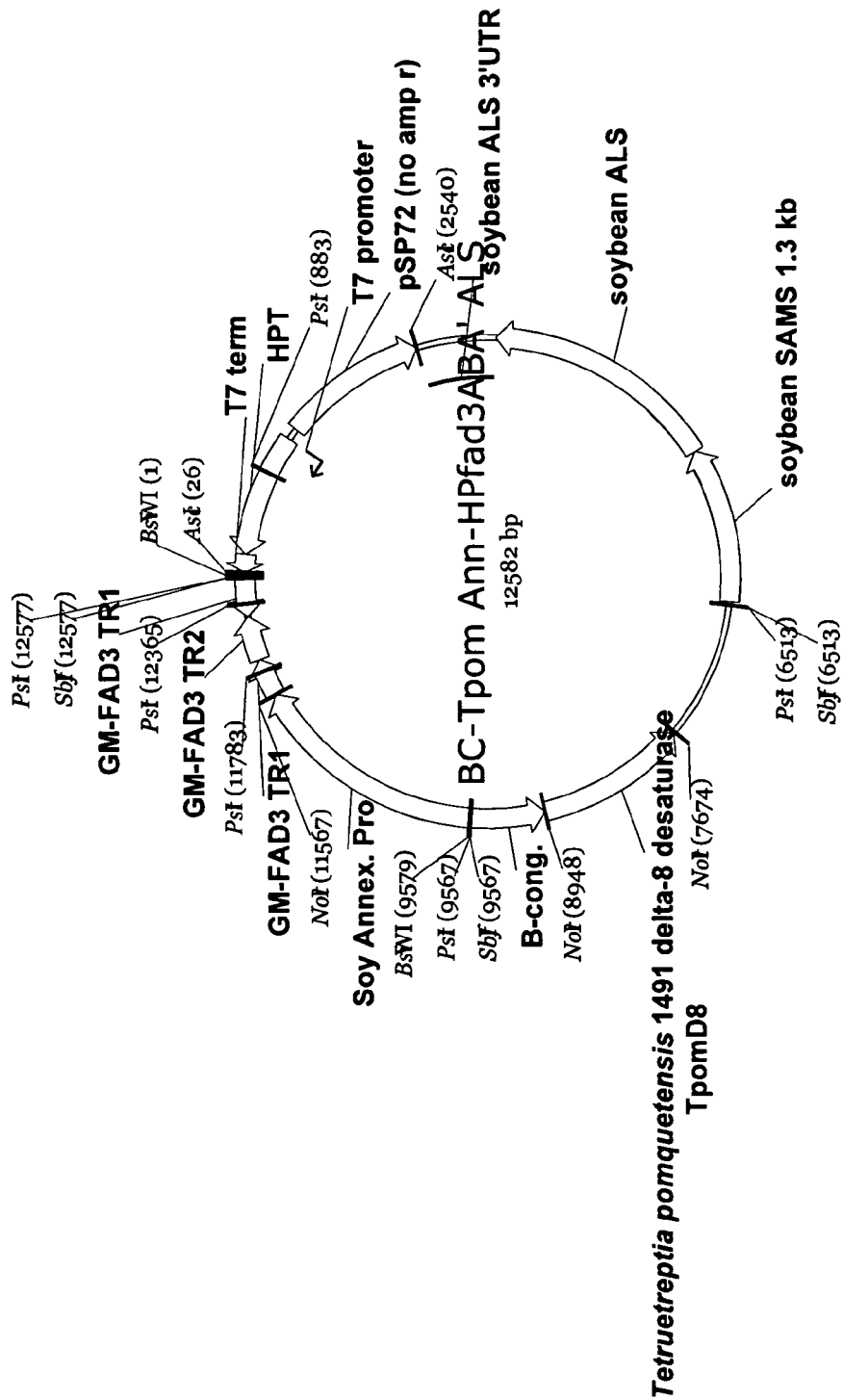
FIG. 11 is a map of plasmid BC-Tpom_Ann-HPfad3ABA'_ALS (see also SEQ ID NO:26).

Ann-HPfad3ABA' is digested with BsiWI and cloned into the BsiWI site of BC-Tpom_ALSrev (SEQ ID NO:11; FIG. 4) to give BC-Tpom_Ann-HPfad3ABA'_ALS (SEQ ID NO:26; FIG. 11). In this way, a region of the soybean delta-15 desaturase that forms a hairpin structure can be expressed behind the strong seed-specific annexin promoter and co-expressed with the TpomD8.

Example 13

*Pavlova lutheri* (CCMP459) Growth, cDNA Synthesis and Delta-8 Desaturase Cloning

*Pavlova lutheri* (CCMP459) was obtained from CCMP and grown in 250 mL flasks containing 50 mL of F/2-Si medium (made using F/2 Family Medium Kit-KIT20F2 and Filtered Seqwater-SEA2 from CCMP) at 26° C. with shaking at 150 rpm. Cultures were transferred to new medium on a weekly basis using 1:4 (old culture:new medium) dilution.

Cultures from 28 flasks (1400 mL) were combined, cells were pelleted by centrifugation at 1,800×g for 10 min, washed once with water and re-centrifuged. Total RNA was extracted from the resulting pellet using the RNA STAT-60™ reagent (TEL-TEST, Inc., Friendswood, Tex.) and following the manufacturer's protocol provided. In this way, 2.6 mg of total RNA (2.6 mg/mL) was obtained from the pellet. The mRNA was isolated from 1.25 mg of total RNA using the mRNA Purification Kit (Amersham Biosciences, Piscataway, N.J.) following the manufacturer's protocol provided. In this way, 112 µg of mRNA was obtained.

cDNA was synthesized from 224 ng of mRNA using the SuperScript™ First-Strand Synthesis System for RT-PCR Kit (Invitrogen™ Life Technologies, Carlsbad, Calif.) with the provided oligo(dT) primer according to the manufacturer's protocol. After RNase H treatment as per the protocol, the *Pavlova lutheri* delta-8 desaturase (PavD8; SEQ ID NO:48; described in Applicants' Assignee's co-pending application having U.S. patent application Ser. No. 11/737,772 (filed Apr. 20, 2007) was amplified from the resulting cDNA with oligonucleotide primers PvDES5'Not-1 (SEQ ID NO:72) and PvDES3'Not-1 (SEQ ID NO:73) using the conditions described below.

cDNA (2 µL) from the reaction described above was combined with 50 pmol of PvDES5'Not-1 (SEQ ID NO:72), 50 pmol of PvDES3'Not-1 (SEQ ID NO:73), 1 µL of PCR nucleotide mix (10 mM, Promega, Madison, Wis.), 5 µL of 10×PCR buffer (Invitrogen Corporation), 1.5 µL of MgCl$_2$ (50 mM, Invitrogen Corporation), 0.5 µL of Taq polymerase (Invitrogen Corporation) and water to 50 µL. The reaction conditions were 94° C. for 3 min followed by 35 cycles of 94° C. for 45 sec, 55° C. for 45 sec and 72° C. for 1 min. The PCR was finished at 72° C. for 7 min and then held at 4° C. The PCR reaction was analyzed by agarose gel electrophoresis on 5 µL and a DNA band with molecular weight around 1.3 kb was observed. The remaining 45 µL of product was separated by agarose gel electrophoresis and the DNA purified using the Zymoclean™ Gel DNA Recovery Kit (Zymo Research, Orange, Calif.) following the manufacturer's protocol. The resulting DNA was cloned into the pGEM®-T Easy Vector (Promega) to give pLF113 (SEQ ID NO:74).

Example 14

Construction of Soybean Expression Vector pKR973 for Co-Expression of the *Pavlova lutheri* Delta-8 Desaturase with the *Euglena gracilis* Delta-9 Elongase and the *Mortierella alpina* Delta-5 Desaturase Vector pKR287 (SEQ ID NO:75; which is described in PCT Publication No. WO 04/071467, published Aug. 26, 2004), contains the *Mortierella alpina* delta-5 desaturase (MaD5) (SEQ ID NO:52), flanked by the soybean glycinin Gy1 promoter and the pea leguminA2 3' termination region (Gy1/MaD5/legA2 cassette). Vector pKR287 was digested with SbfI/BsiWI and the fragment containing the Gy1/MaD5/legA2 cassette was cloned into the SbfI/BsiWI fragment of pKR277 (SEQ ID NO:4; which is described in Example 4 and in PCT Publication No. WO 04/071467) to produce pK952 (SEQ ID NO:77).

Through a number of sub-cloning steps, sequences containing Asp718 restriction sites were added to the 5' and 3' ends of the Kti/NotI/Kti3'Salb3' cassette from pKR457 (SEQ ID NO:2; described in Example 4) to give SEQ ID NO:70.

Plasmid pLF113 (SEQ ID NO:74; described in Example 13) was digested with NotI and the fragment containing the PavD8 was cloned into the NotI site of the modified Kti/NotI/Kti3'Salb3' cassette (SEQ ID NO:70), and then the resulting DNA fragment was digested with Asp718 and cloned into the SbfI site of pKR952 (SEQ ID NO:77) to give pKR970 (SEQ ID NO:71).

Figure 15:
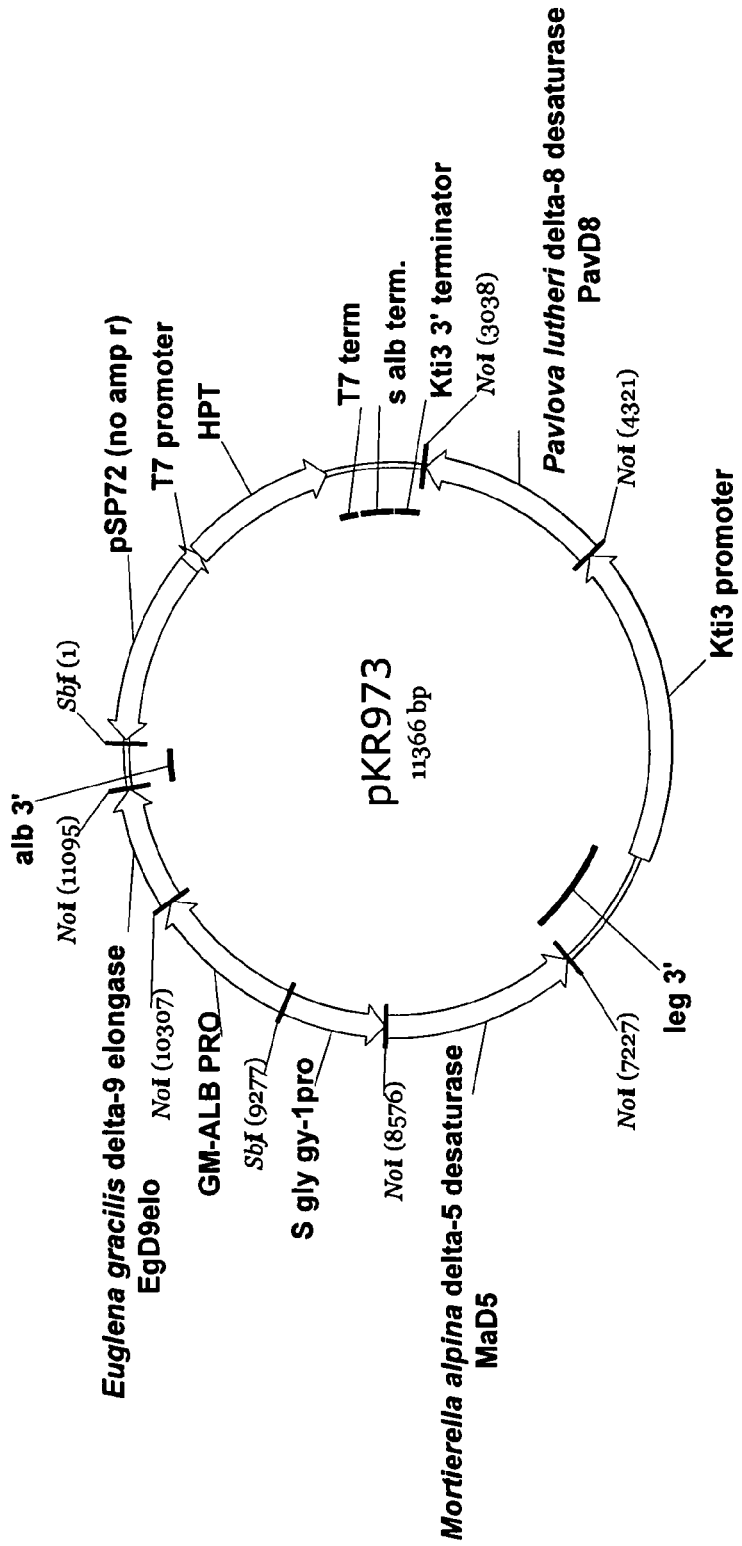
FIG. 15 is a map of plasmid pKR973 (see also SEQ ID NO:41).

Plasmid pKR953 (SEQ ID NO:6) was digested with PstI and the fragment containing the EgD9elo was cloned into the SbfI site of pKR970 (SEQ ID NO:71) to give pKR973 (SEQ ID NO:41, FIG. 15).

In this way, the *Pavlova lutheri* delta-8 desaturase (PavD8) could be co-expressed with the *Mortierella alpina* delta-5 desaturase (MaD5) and the *Euglena gracilis* delta-9 elongase (EgD9elo) behind strong, seed-specific promoters.

Example 15

Soybean Embryos Transformed with Soybean Expression Vectors pKR1005 and pKR973

Figure 16:
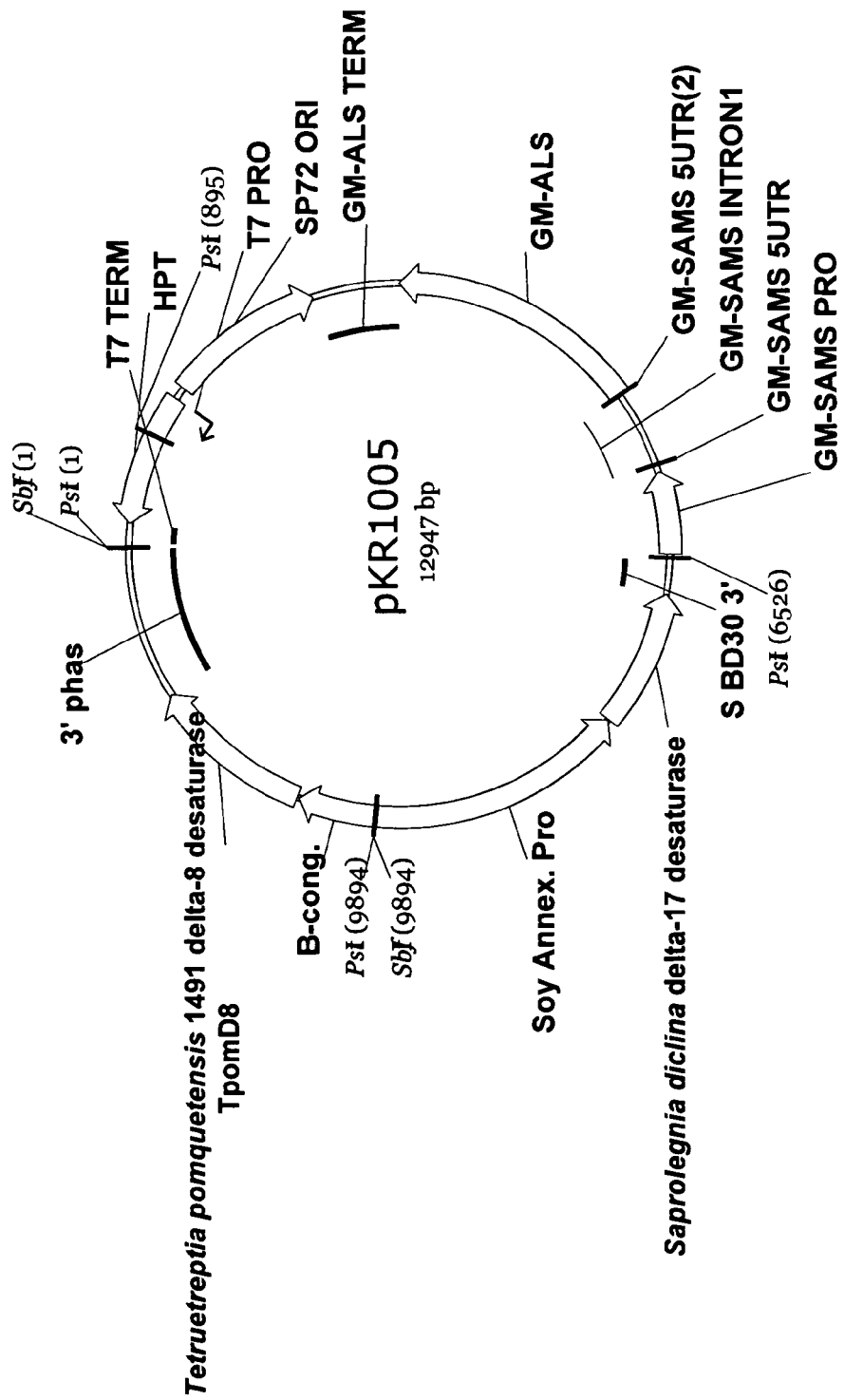
FIG. 16 is a map of plasmid pKR1005 (see also SEQ ID NO:44).
Figure 18:
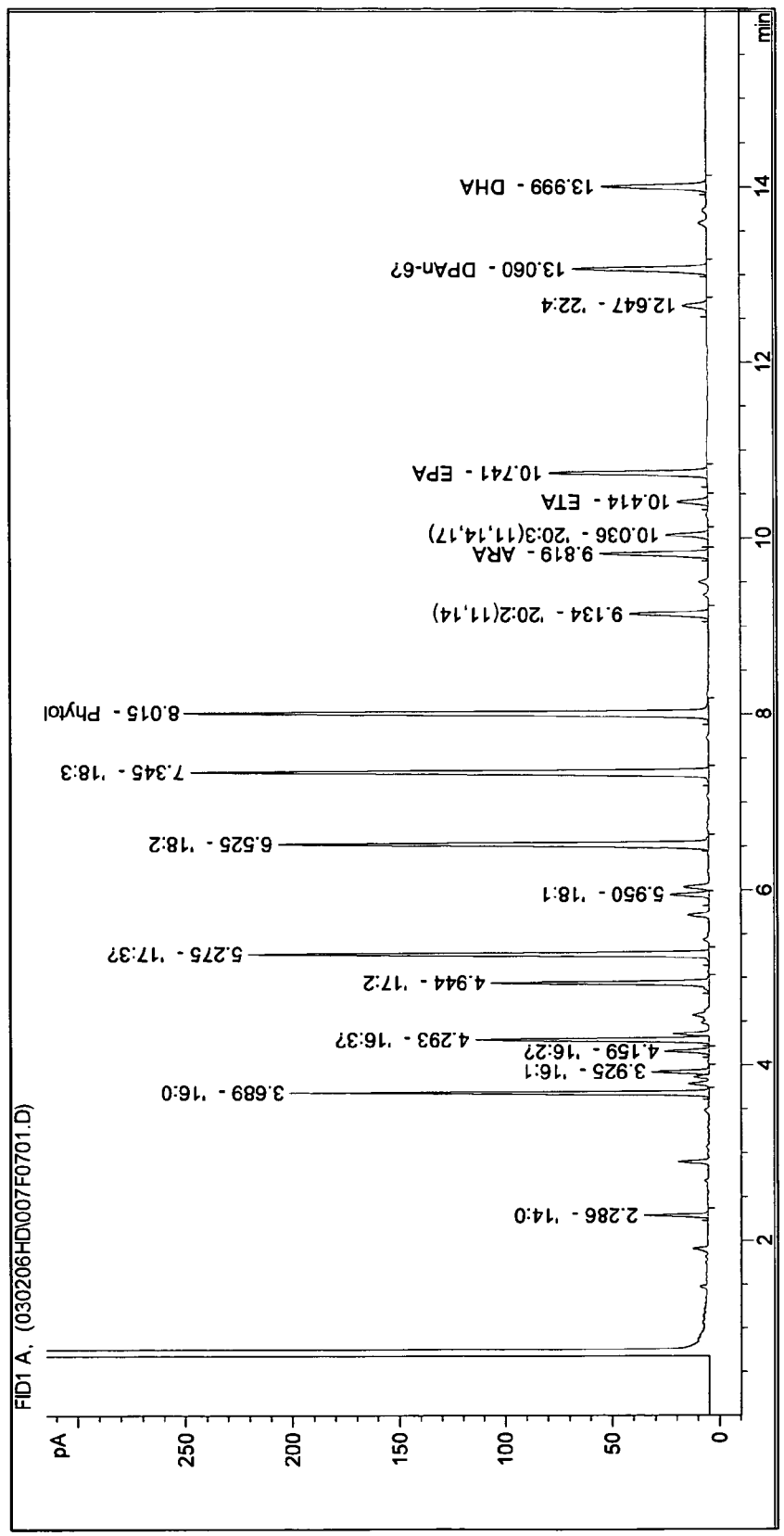
FIG. 18 shows a chromatogram of the lipid profile of an *Euglena anabaena* cell extract as described in the Examples.

Containing the *Pavlova lutheri* Delta-8 Desaturase, the *Mortierella alpina* Delta-5 Desaturase, the *Euglena gracilis* Delta-9 Elongase, the *Tetruetrentia pomquetensis* Delta-8 Desaturase and the *Saprolegnia diclina* Delta-17 Desaturase pKR973 (SEQ ID NO:41; FIG. 15; described in Example 14) contains Pav D8, MaD5 and EgD9elo. pKR1005 (SEQ ID NO:44; FIG. 16; described below) contains TpomD8 and Sd17.

The PstI fragment, containing the Ann/SdD17/BD30 cassette from pKR271 (SEQ ID NO:65; which is described in PCT Publication No. WO 04/071467) was cloned into the SbfI site of pKR226 (SEQ ID NO:9; which is also described in PCT Publication No. WO 04/071467) to produce vector pKR886r (SEQ ID NO:66; described in Applicants' Assignee's co-pending application having U.S. application Ser. No. 11/601,563 (filed Nov. 16, 2006, which published May 24, 2007; and the contents of which are hereby incorporated by reference).

TpomD8 was released from plasmid pLF114-10 (SEQ ID NO:64; see Example 5) by digestion with NotI and was cloned into the NotI site of plasmid pKR179 (SEQ ID NO:24) to produce pKR1002 (SEQ ID NO:8). Vector pKR1002 (SEQ ID NO:8) was digested with PstI and the fragment containing the TpomD8 (SEQ ID NO:50) was cloned into the SbfI site of pKR886r (SEQ ID NO:66) to produce pKR1005 (SEQ ID NO:44; FIG. 16; see Applicants' Assignee's co-pending application having U.S. patent application Ser. No. 11/876, 115 (filed Oct. 22, 2007; and the contents of which are hereby incorporated by reference).

Soybean embryogenic suspension culture (cv. Jack) was transformed with the AscI fragments of pKR1005 (SEQ ID NO:44; FIG. 16) and pKR973 (SEQ ID NO:41; FIG. 15; see Applicants' Assignee's co-pending application having U.S. patent application Ser. No. 11/737,772 (filed Apr. 20, 2007) (fragments containing the expression cassettes), as described herein. A subset of soybean embryos generated from each event (ten embryos per event) were are harvested, picked into glass GC vials, fatty acid methyl esters (FAMEs) were are prepared by transesterification and analyzed by GC as described in Example 10. Retention times were compared to those for methyl esters of standards commercially available (Nu-Chek Prep, Inc.).

In this way, 373 events transformed with pKR1005 (SEQ ID NO:44; FIG. 16) and pKR973 (SEQ ID NO:41) (experiment called Heal 17) were analyzed. From the 373 events analyzed, 56 were identified that produced ARA in at least one embryo out of ten analyzed at a relative abundance greater than 1.0% of the total fatty acids. Of these, 2 were identified that produced ARA in at least one embryo out of ten analyzed at a relative abundance greater than 10.0% of the total fatty acids. High levels of ARA are likely due to lower relative expression of the SdD17 gene in those events.

The fatty acid profiles for embryos from one of these events (4828-4-18) having the highest ARA are shown in FIG. 17. The fatty acid profile for one embryo (4828-4-18-4) was discarded as no signal was obtained. In this event, levels of ARA in individual embryos are as high as 20.3% of the total fatty acids, levels of EPA in individual embryos are less than 5.5% of the total fatty acids and levels of GLA in individual embryos are less than 1.2% of the total fatty acids. Fatty acids are identified as 16:0 (palmitate), 18:0 (stearic acid), 18:1 (oleic acid), LA, GLA, ALA, EDA, DGLA, ARA, ERA, JUN, ETA, EPA and DPA; and, fatty acid compositions listed in FIG. 17 are expressed as a weight percent (wt. %) of total fatty acids. For FIG. 17, fatty acids listed as "others" include: 18:2 (5,9), STA, 20:0, 20:1(11), 20:2 (7,11) or 20:2 (8,11) and SCI. Each of these fatty acids is present at a relative abundance of less than 2.2% of the total fatty acids.

Example 16

Construct Combinations for Generating ARA

Figure 14:
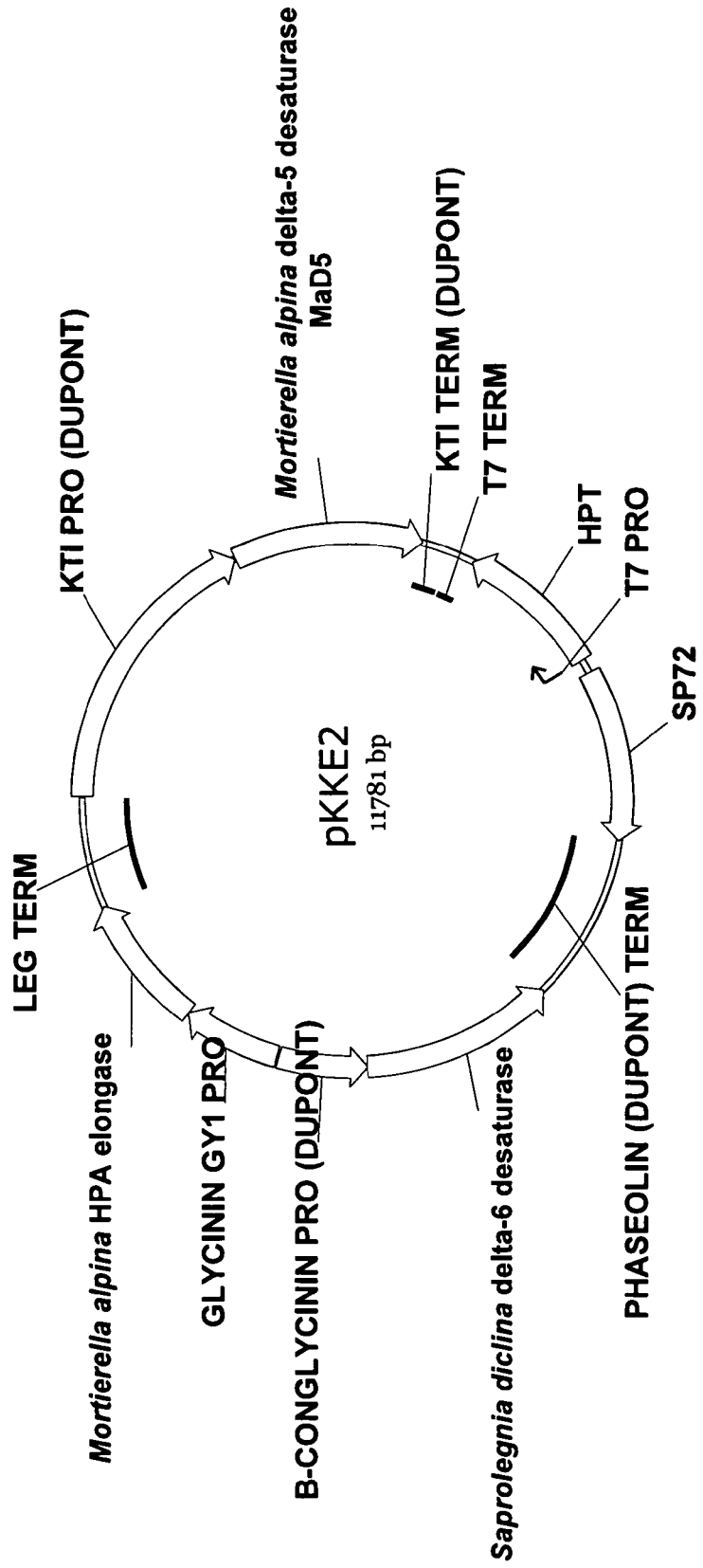
FIG. 14 is a map of plasmid pKKE2 (see also SEQ ID NO:40).

Construct combinations (AscI fragments containing gene cassettes) described in FIG. 12 are transformed into soybean embryogenic suspension culture (cv. Jack), embryos are matured and plants re-generated as described for production in Example 1. Embryos and seed are analyzed for fatty acid profiles as described in Example 2. pKKE2 (SEQ ID NO:40; FIG. 14; ATCC Accession No. PTA-4987), pKR1084 (SEQ ID NO:7) and pKR973 (SEQ ID NO:41, FIG. 15) are listed as Construct 1. pKR973 contains, in addition to EgD9elo and MaD5 described herein, a *Pavlova lutheri* delta-8 desaturase (PavD8) (Applicants' Assignee's co-pending application having U.S. patent application Ser. No. 11/737,772 (filed Apr. 20, 2007; the contents of which are hereby incorporated by reference).

Example 17

Construction of Alternate Soybean Expression Vectors for Expression of ARA Biosynthetic Pathways In addition to the genes, ELVISLIVES constructs, hairpins, promoters, terminators and gene cassettes described herein, one skilled in the art can appreciate that other promoter/gene/terminator, promoter/hairpin, and promoter/ELVISLIVES/terminator cassette combinations can be synthesized in a way similar to, but not limited to, that described herein. Also, other hairpin constructs could be generated that would effectively down-regulate fad3 when expressed. Similarly, it may be desirable to express other PUFA genes (such as those described below in Table 9), for co-expression with any of the genes, ELVISLIVES constructs, hairpins, promoters, terminators and gene cassettes described herein.

For instance, PCT Publication Nos. WO 04/071467 and WO 04/071178 describe the isolation of a number of promoter and transcription terminator sequences for use in embryo-specific expression in soybean. Furthermore, PCT Publication Nos. WO 04/071467, WO 05/047479 and WO 06/012325 describe the synthesis of multiple promoter/gene/terminator cassette combinations by ligating individual promoters, genes and transcription terminators together in unique combinations. Generally, a NotI site flanked by the suitable promoter (such as those listed in, but not limited to, Table 7) and a transcription terminator (such as those listed in, but not limited to, Table 8) is used to clone the desired gene or ELVISLIVES construct. NotI sites can be added to a gene of interest such as those listed in, but not limited to, Table 9 using PCR amplification with oligonucleotides designed to introduce NotI sites at the 5' and 3' ends of the gene. The resulting PCR product is then digested with NotI and cloned into a suitable promoter/NotI/terminator cassette. Similarly, any suitable fad3 hairpin could be cloned behind promoters such as those listed in, but not limited to Table 7. Generally, a NotI site at the 5' end of the hairpin and an Asp718 and SbfI site at the 3' end of the hairpin is preferred although other restriction sites could be used. The hairpin is then cloned into the NotI/Asp718 sites behind a suitable promoter.

In addition, PCT Publication Nos. WO 04/071467, WO 05/047479 and WO 06/012325 describe the further linking together of individual gene cassettes in unique combinations, along with suitable selectable marker cassettes, in order to obtain the desired phenotypic expression. Although this is done mainly using different restriction enzymes sites, one skilled in the art can appreciate that a number of techniques can be utilized to achieve the desired promoter/gene/transcription terminator combination. In so doing, any combination of embryo-specific promoter/gene/transcription terminator, promoter/ELVISLIVES/transcription terminator or promoter/hairpin can be achieved. One skilled in the art can also appreciate that these cassettes can be located on individual DNA fragments or on multiple fragments where co-expression of genes, ELVISLIVES constructs and/or hairpins is the outcome of co-transformation of multiple DNA fragments.

TABLE 7

Seed-specific Promoters

| Promoter | Organism | Promoter Reference |
|---|---|---|
| β-conglycinin α'-subunit | soybean | Beachy et al., EMBO J. 4: 3047-3053 (1985) |
| kunitz trypsin inhibitor | soybean | Jofuku et al., *Plant Cell* 1: 1079-1093 (1989) |
| Annexin | soybean | WO 2004/071467 |
| glycinin Gy1 | soybean | WO 2004/071467 |
| albumin 2S | soybean | U.S. Pat. No. 6,177,613 |
| legumin A1 | pea | Rerie et al., *Mol. Gen. Genet.* 225: 148-157 (1991) |
| β-conglycinin β-subunit | soybean | WO 2004/071467 |
| BD30 (also called P34) | soybean | WO 2004/071467 |
| legumin A2 | pea | Rerie et al., *Mol. Gen. Genet.* 225: 148-157 (1991) |

TABLE 8

Transcription Terminators

| Transcription Terminator | Organism | Reference |
|---|---|---|
| phaseolin 3' | bean | WO 2004/071467 |
| kunitz trypsin inhibitor 3' | soybean | WO 2004/071467 |
| BD30 (also called P34) 3' | soybean | WO 2004/071467 |
| legumin A2 3' | pea | WO 2004/071467 |
| albumin 2S 3' | soybean | WO 2004/071467 |

TABLE 9

PUFA Biosynthetic Pathway Genes

| Gene | Organism | Reference |
|---|---|---|
| delta-6 desaturase | *Saprolegnia diclina* | WO 2002/081668 |
| delta-6 desaturase | *Mortierella alpina* | U.S. Pat. No. 5,968,809 |
| elongase | *Mortierella alpina* | WO 2000/12720 U.S. Pat. No. 6,403,349 |
| delta-5 desaturase | *Mortierella alpina* | U.S. Pat. No. 6,075,183 |
| delta-5 desaturase | *Saprolegnia diclina* | WO 2002/081668 |
| delta-5 desaturase | *Peridinium* sp. | U.S. Provisional Application No. 60/801,119 |
| delta-5 desaturase | *Euglena gracilis* | U.S. Provisional Application No. 60/801,172 |
| delta-9 elongase | *Isochrysis galbana* | WO 2002/077213 |
| delta-9 elongase | *Euglena gracilis* | U.S. patent application Ser. No. 11/601,563 |
| delta-9 elongase | *Eutreptiella* sp. CCMP389 | U.S. patent application Ser. No. 11/601,564 |
| delta-8 desaturase | *Euglena gracilis* | WO 2000/34439 U.S. Pat. No. 6,825,017 WO 2004/057001 WO 2006/012325 |
| delta-8 desaturase | *Acanthamoeba castellanii* | Sayanova et al., *FEBS Lett.* 580: 1946-1952 (2006) |
| delta-8 desaturase | *Pavlova salina* | WO 2005/103253 |
| delta-8 desaturase | *Pavlova lutheri* | U.S. patent application Ser. No. 11/737,772 |
| delta-8 desaturase | *Tetruetreptia pomquetensis* CCMP1491 | U.S. patent application Ser. No. 11/876,115 |
| delta-8 desaturase | *Eutreptiella* sp. CCMP389 | U.S. patent application Ser. No. 11/876,115 |
| delta-8 desaturase | *Eutreptiella cf_gymnastica* CCMP1594 | U.S. patent application Ser. No. 11/876,115 |

Example 18

Identification of DHA Synthase 1 (EgDHAsyn1) from *Euglena gracilis* cDNA Library eeg1c The present Example describes the cloning of a DHA synthase from *Euglena gracilis*. This work is also described in U.S. Provisional Application No. 60/909,790 (filed Apr. 3, 2007) the contents of which are hereby incorporated by reference).

Clones from the *Euglena* cDNA library (eeg1c; see Example 3 and WO 2007/061845 which published May 31, 2007 (the contents of which are hereby incorporated by reference)) were plated and DNA was isolated and sequenced. For sequencing, clones first were recovered from archived glycerol cultures grown/frozen in 384-well freezing media plates, and inoculated with an automatic QPix colony picker (Genetix) in 96-well deep-well plates containing LB+50 µg/mL kanamycin. After growing 20 h at 37° C., cells were pelleted by centrifugation and stored at −20° C. Plasmids then were isolated on an Eppendorf 5Prime robot, using a modified 96-well format alkaline lysis miniprep method (Eppendorf PerfectPrep). Briefly, a filter and vacuum manifold was used to facilitate removal of cellular debris after acetate precipitation. Plasmid DNA was then bound on a second filter plate directly from the filtrate, washed, dried and eluted.

Plasmids were end-sequenced in 384-well plates, using vector-primed M13F Universal primer (SEQ ID NO:78) and the ABI BigDye version 3 Prism sequencing kit. For the sequencing reaction, 100-200 ng of template and 6.4 pmol of primer were used, and the following reaction conditions were repeated 25 times: 96° C. for 10 sec, 50° C. for 5 sec and 60° C. for 4 min. After ethanol-based cleanup, cycle sequencing reaction products were resolved and detected on Perkin-Elmer ABI 3700 automated sequencers.

cDNA clones encoding C20-polyunsaturated fatty acid elongating enzyme homologs (C20-PUFA Elo) were identified by conducting BLAST (Basic Local Alignment Search Tool; Altschul et al., *J. Mol. Biol.* 215:403-410 (1993)) searches for similarity to sequences contained in the BLAST "nr" database (comprising all non-redundant GenBank CDS translations, sequences derived from the 3-dimensional structure Brookhaven Protein Data Bank, the last major release of the SWISS-PROT protein sequence database, EMBL and DDBJ databases). The cDNA sequences from eeg1c were analyzed for similarity to all publicly available DNA sequences contained in the "nr" database using the BLASTN algorithm provided by the National Center for Biotechnology Information (NCBI). The DNA sequences were translated in all reading frames and compared for similarity to all publicly available protein sequences contained in the "nr" database using the BLASTX algorithm (Gish and States, *Nat. Genet.* 3:266-272 (1993)) provided by the NCBI. For convenience, the P-value (probability) of observing a match of a cDNA sequence to a sequence contained in the searched databases merely by chance as calculated by BLAST are reported herein as "p Log" values, which represent the negative of the logarithm of the reported P-value. Accordingly, the greater the p Log value, the greater the likelihood that the cDNA sequence and the BLAST "hit" represent homologous proteins.

The BLASTX search using the nucleotide sequences from clone eeg1c.pk016.e6.f (also called pKR1049) revealed similarity of the protein encoded by the cDNA to the C20-PUFA Elo from *Pavlova* sp. CCMP459 (SEQ ID NO:79) (NCBI Accession No. AAV33630 (GI 54307108), locus AAV33630, CDS AY630573; Pereira et al., *Biochem. J.* 384:357-366 (2004)). The sequence of a portion of the cDNA insert from clone eeg1c.pk016.e6.f is shown in SEQ ID NO:80 (5' end of cDNA insert). Subsequently, the full insert sequence of eeg1c.pk016.e6.f:fis was obtained and is shown in SEQ ID NO: 81. The coding sequence is set forth in SEQ ID NO:82. The corresponding deduced amino acid sequence is set forth in SEQ ID NO:83.

Full insert sequencing was carried out using a modified transposition protocol. Clones identified for FIS were recovered from archived glycerol stocks as single colonies, and plasmid DNA was isolated via alkaline lysis. Plasmid templates were transposed via the Template Generation System (TGS II) transposition kit (Finnzymes Oy, Espoo, Finland), following the manufacturer's protocol. The transposed DNA was transformed into EH10B electro-competent cells (Edge BioSystems, Gaithersburg, Md.) via electroporation. Multiple transformants were randomly selected from each transposition reaction, plasmid DNA was prepared, and templates were sequenced as above (ABI BigDye v3.1) outward from the transposition event site, utilizing unique primers SeqE (SEQ ID NO:171) and SeqW (SEQ ID NO:172).

The amino acid sequence set forth in SEQ ID NO:83 was evaluated by BLASTP. Interestingly, SEQ ID NO:83 was found to be similar to both C20-PUFA Elo and delta-4 fatty acid desaturase. The N-terminus of SEQ ID NO:83 (from approximately amino acid 16-268) yields a p Log value of 60.30 (E value of 5e-61; 124/258 identical amino acids; 48% identity) versus the *Pavlova* sp. CCMP459 C20-PUFA Elo (SEQ ID NO:79). The C-terminus of SEQ ID NO:83 (from approximately amino acid 253-793) yields an E value of 0.0 (535/541 identical amino acids; 98% identity), versus the delta-4 fatty acid desaturase from *Euglena gracilis* (SEQ ID NO:84) (NCBI Accession No. AAQ19605 (GI 33466346), locus AAQ19605, CDS AY278558; Meyer et al., *Biochemistry* 42(32):9779-9788 (2003)). BLAST scores and probabilities indicate that the instant nucleic acid fragment (SEQ ID NO:82) encodes an entire *Euglena gracilis* C20-PUFA Elo/delta-4 fatty acid desaturase multizyme, hereby named *Euglena gracilis* DHA synthase 1 (EgDHAsyn1).

The amino acid sequence of EgDHAsyn1 (SEQ ID NO:83) is 47.8% identical to the C20-PUFA Elo from *Pavlova* sp. CCMP459 (SEQ ID NO:79) and 98.9% identical to the delta-4 fatty acid desaturase from *Euglena gracilis* (SEQ ID NO:84), using the Jotun Hein method. Sequence percent identity calculations performed by the Jotun Hein method (Hein, J. J., *Meth. Enz.* 183:626-645 (1990)) were done using the MegAlign™ v6.1 program of the LASARGENE bioinformatics computing suite (DNASTAR Inc., Madison, Wis.) with the default parameters for pairwise alignment (KTUPLE=2).

The amino acid sequence of EgDHAsyn1 (SEQ ID NO: 83) is 41.2% identical to the C20-PUFA Elo from *Pavlova* sp. CCMP459 (SEQ ID NO:79) and 98.9% identical to the delta-4 fatty acid desaturase from *Euglena gracilis* (SEQ ID NO:84), using the Clustal V method. Sequence percent identity calculations performed by the Clustal V method (Higgins, D. G. and Sharp, P. M., *Comput. Appl. Biosci.* 5:151-153 (1989); Higgins et al., *Comput. Appl. Biosci.* 8:189-191 (1992)) were done using the MegAlign™ v6.1 program of the LASARGENE bioinformatics computing suite (supra) with the default parameters for pairwise alignment (KTUPLE=1, GAP PENALTY=3, WINDOW=5 and DIAGONALS SAVED=5 and GAP LENGTH PENALTY=10).

The C20 elongase domain of EgDHAsyn1 was defined based on comparison of the amino acid sequence of EgDHAsyn1 (SEQ ID NO:83) to *Pavlova* sp. CCMP459 C20-PUFA Elo (SEQ ID NO:79), *Ostreococcus tauri* PUFA elongase 2 (SEQ ID NO:25 85) (NCBI Accession No. AAV67798 (GI 55852396), locus AAV67798, CDS AY591336; Meyer et al., *J. Lipid Res.* 45(10):1899-1909 (2004)) *Thalassiosira pseudonana* PUFA elongase 2 (SEQ ID NO:86) (NCBI Accession No. AAV67800 (GI 55852441), locus AAV67800, CDS AY591338; Meyer et al., *J. Lipid Res.* 45(10):1899-1909 (2004)), *Euglena gracilis* delta-4 fatty acid desaturase (SEQ ID NO:84), *Thraustochytrium aureum* delta-4 desaturase (SEQ ID NO:87) (NCBI Accession No. AAN75707 (GI 25956288), locus AAN75707, CDS AF391543), *Schizochytrium aggregatum* delta-4 desaturase (SEQ ID NO:88) (PCT Publication No. WO 2002/090493), *Thalassiosira pseudonana* delta-4 desaturase (SEQ ID NO:89) (NCBI Accession No. AAX14506 (GI 60173017), locus AAX14506, CDS AY817156; Tonon et al., *FEBS J.* 272 (13):3401-3412 (2005)) and *Isochrysis galbana* delta-4 desaturase (SEQ ID NO:90) (NCBI Accession No. AAV33631 (GI 54307110), locus AAV33631, CDS AY630574; Pereira et al., *Biochem. J.* 384(2):357-366 (2004) and PCT Publication No. WO 2002/090493). The nucleotide and corresponding amino acid sequences for the EgDHAsyn1 C20 elongase domain from EgDHAsyn1 are set forth in SEQ ID NO:91 and SEQ ID NO:92, respectively.

At the C-terminus of the C20 elongase domain of EgDHAsyn1, there is a repeated sequence containing an NG motif (i.e., KNGK (SEQ ID NO:93), PENGA (SEQ ID NO:94), PENGA (SEQ ID NO:95), PCENGTV (SEQ ID NO:96); called NG repeats. Although the pattern occurs with a high probability of occurrence, a scan of the NG repeated region using Prosite shows the last NG motif in this region as a potential N-glycosylation site (NGTV). After the NG repeat region, EgDHAsyn1 contains a proline-rich region (called Proline-rich linker), which may act as a linker between the C20 elongase and delta-4 desaturase domains. The linker may play a role in keeping the C20 elongase and delta-4 desaturase domains in the proper structural orientation to allow efficient conversion of eicosapentaenoic acid (EPA) to docosahexaenoic acid (DHA). Although the proline-rich linker is defined as extending from P304 to V321 (based on numbering for EgDHAsyn1), the NG repeat region is also somewhat proline-rich and may also play a role in this linker function. The nucleotide and corresponding amino acid sequences for the proline-rich linker of EgDHAsyn1 are set forth in SEQ ID NO:97 and SEQ ID NO98, respectively.

Example 19

Identification of a Delta-9 Elongase from *Euglena anabaena* UTEX 373

The present Example describes the synthesis of a cDNA library from *Euglena anabaena* UTEX 373 including the generation of RNA, synthesis of cDNA, and generation of a cDNA library and the identification of a delta-9 elongase. This work is also described in U.S. Provisional Patent Application No. 60/911,925 (filed Apr. 16, 2007) the contents of which are hereby incorporated by reference).

Growth of *Euglena anabaena* UTEX 373 and Preparation of RNA

*Euglena anabaena* UTEX 373 was obtained from Dr. Richard Triemer's lab at Michigan State University (East Lansing, Mich.). Approximately 2 mL of culture was removed for lipid analysis and centrifuged at 1,800×g for 5 min. The pellet was washed once with water and re-centrifuged. The resulting pellet was dried for 5 min under vacuum, resuspended in 100 μL of trimethylsulfonium hydroxide (TMSH) and incubated at room temperature for 15 min with shaking. After incubation, 0.5 mL of hexane was added and the vials were further incubated for 15 min at room temperature with shaking. Fatty acid methyl esters (5 μL injected from hexane layer) were separated and quantified using a Hewlett-Packard 6890 Gas Chromatograph fitted with an Omegawax 320 fused silica capillary column (Supelco Inc., Cat. No. 24152). The oven temperature was programmed to hold at 170° C. for 1.0 min, increase to 240° C. at 5° C./min and then hold for an additional 1.0 min. Carrier gas was supplied by a Whatman hydrogen generator. Retention times were compared to those for methyl esters of standards commercially available (Nu-Chek Prep, Inc. Cat. No. U-99-A) and the resulting chromatogram is shown in FIG. 18. The presence of EDA, ERA, EPA and DHA in the fatty acid profile, with the absence of GLA and STA, suggested that *Euglena anabaena* uses the delta-9 elongase/delta-8 desaturase pathway for LC-PUFA biosynthesis and would be a good source for LC-PUFA biosynthetic genes such as, but not limited to, delta-9 elongases.

The remaining 5 mL of an actively growing culture was transferred into 25 mL of AF-6 Medium (Watanabe & Hiroki, NIES-Collection List of Strains, 5th ed., National Institute for Environmental Studies, Tsukuba, 127 pp (2004)) in a 125 mL glass flask. *Euglena anabaena* cultures were grown at 22° C. with a 16 h light, 8 h dark cycle for 2 weeks with very gentle agitation.

After 2 weeks, the culture (25 mL) was transferred to 100 mL of AF-6 medium in a 500 mL glass bottle and the culture was grown for 1 month as described above. After this time, two 50 mL aliquots were transferred into two separate 500 mL glass bottles containing 250 mL of AF-6 medium and the cultures were grown for two months as described above (giving a total of ~600 mL of culture). After this, the cultures were pelleted by centrifugation at 1,800×g for 10 min, washed once with water and re-centrifuged. Total RNA was extracted from one of the resulting pellets using the RNA STAT-60™ reagent (TEL-TEST, Inc., Friendswood, Tex.) and following the manufacturer's protocol provided (use 5 mL of reagent, dissolved RNA in 0.5 mL of water). In this way, 340 μg of total RNA (680 μg/mL) was obtained from the pellet. The remaining pellet was frozen in liquid nitrogen and stored at −80° C. The mRNA was isolated from all 340 μg of total RNA using the mRNA Purification Kit (Amersham Biosciences, Piscataway, N.J.) following the manufacturer's protocol provided. In this way, 9.0 μg of mRNA was obtained.

Preparation of *Euglena anabaena* cDNA and Generation of cDNA Library eug1c

A cDNA library was generated using the Cloneminer™ cDNA Library Construction Kit (Cat. No. 18249-029, Invitrogen Corporation, Carlsbad, Calif.) and following the manufacturer's protocol provided (Version B, 25-0608). Using the non-radiolabeling method, cDNA was synthesized from 5.12 μg of mRNA (described above) using the Biotin-attB2-Oligo (dT) primer. After synthesis of the first and second strand, the attB1 adapter was added, ligated and the cDNA was size fractionated using column chromatography. DNA from fractions were concentrated, recombined into pDONR™222 and transformed into *E. coli* ElectroMAX™ DH10B™ T1 Phage-Resistant cells (Invitrogen Corporation). The *Euglena anabaena* library was named eug1c.

The cDNA library eug1c was plated onto LBKan plates (approx. 100,000 colonies), the colonies were scraped off and DNA was isolated using the QIAprep® Spin Miniprep Kit (Qiagen Inc., Valencia, Calif.) following the manufacturer's protocol. In this way, a plasmid DNA sub-library from eug1c was obtained.

Colony Lifts:

Approximately 17,000 clones of cDNA library eug1c were plated onto three large square (24 cm×24 cm) petri plates (Corning, Corning, N.Y.) each containing LB+50 µg/mL kanamycin agar media. Cells were grown overnight at 37° C. and plates were then cooled to room temperature.

Biodyne B 0.45 µm membrane (Cat. No. 60207, Pall Corporation, Pensacola, Fla.) was trimmed to approximately 22 cm×22 cm and the membrane was carefully layed on top of the agar to avoid air bubbles. After incubation for 2 min at room temperature, the membrane was marked for orientation, lifted off with tweezers and placed colony-side up on filter paper soaked with 0.5 M sodium hydroxide and 1.5 M sodium chloride. After denaturation for 4 min, the sodium hydroxide was neutralized by placing the membrane on filter paper soaked with 0.5 M Tris-HCL (pH 7.5) and 1.5 M sodium chloride for 4 min. This step was repeated and the membrane was rinsed briefly in 2×SSC buffer (20×SSC is 3M sodium chloride, 0.3 M sodium citrate; pH 7.0) and air dried on filter paper.

Hybridization:

Membranes were pre-hybridized at 65° C. in 200 mL hybridization solution for 2 h. Hybridization solution contained 6×SSPE (20×SSPE is 3 M sodium chloride, 0.2 M sodium phosphate, 20 mM EDTA; pH 7.4), 5×Denhardt's reagent (100×Denhardt's reagent is 2% (w/v) Ficoll, 2% (w/v) polyvinylpyrrolidone, 2% (w/v) acetylated bovine serum albumin), 0.5% sodium dodecyl sulfate (SDS), 100 µg/mL sheared salmon sperm DNA and 5% dextran sulfate.

A DNA probe was made using an agarose gel purified NcoI/NotI DNA fragment, containing the *Euglena gracilis* delta-9 elongase gene, from pKR906 (SEQ ID NO:46; Example 4) labeled with $P^{32}$ dCTP using the RadPrime DNA Labeling System (Cat. No. 18428-011, Invitrogen, Carlsbad, Calif.) following the manufacture's instructions. Unincorporated $P^{32}$ dCTP was separated using a NICK column (Cat. No. 17-0855-02, Amersham Biosciences, Piscataway, N.J.) following the manufacturer's instructions. The probe was denatured for 5 min at 100° C., placed on ice for 3 min and half was added to the hybridization solution.

The membrane was hybridized with the probe overnight at 65° C. with gentle shaking and then washed the following day twice with 2×SSC containing 0.5% SDS (5 min each) and twice with 0.2×SSC containing 0.1% SDS (15 min each). After washing, hyperfilm (Cat. No. RPN30K, Amersham Biosciences, Piscataway, N.J.) was exposed to the membrane overnight at −80° C.

Based on alignment of plates with the exposed hyperfilm, positive colonies were picked using the blunt end of a Pasteur pipette into 1 mL of water and vortexed. Several dilutions were made and plated onto small round Petri dishes (82 mm) containing LB media plus 50 µg/mL kanamycin to obtain around 100 well isolated colonies on a single plate. Lifts were done as described above except NytranN membrane circles (Cat, No. 10416116, Schleicher & Schuell, Keene, N.H.) were used and hybridization was carried out in 100 mL using the remaining radiolabeled probe. In this way, positive clones were confirmed.

Individual positive clones were grown at 37° C. in LB+50 µg/mL kanamycin liquid media and plasmid was purified using the QIAprep® Spin Miniprep Kit (Qiagen Inc.) following the manufacturer's protocol.

DNA inserts were end-sequenced in 384-well plates as described in Example 18 and sequences were aligned and compared using Sequencher™ (Version 4.2, Gene Codes Corporation, Ann Arbor, Mich.). In this way, the clones could be categorized into one of two distinct groups based on insert sequence (called EaD9Elo1 and EaD9Elo2). Representative clones containing the cDNA for each class of sequence were chosen for further study and sequences for each representative plasmid (pLF121-1 and pLF121-2) are shown in SEQ ID NO:99 and SEQ ID NO:100, respectively. The sequence shown by a string of NNNN's represents a region of the polyA tail which was not sequenced. The coding sequences for EaD9Elo1 and EaD9Elo2 are shown in SEQ ID NO:101 and SEQ ID NO:102, respectively. The corresponding amino acid sequences for EaD9Elo1 and EaD9Elo2 are shown in SEQ ID NO:103 and SEQ ID NO:104, respectively.

Example 20

Identification of a Delta-5 Desaturase from *Euglena anabaena* UTEX 373

The present Example describes the identification of a delta-5 desaturase from *Euglena anabaena* UTEX 373. This work is also described in U.S. Provisional Application No. 60/915,733 (filed May 3, 2007) the contents of which are hereby incorporated by reference).

Amplified cDNA library eug1c was plated and colonies lifted as described in Example 19. A DNA probe was made using an agarose gel purified NcoI/NotI DNA fragment containing the *Euglena gracilis* delta-5 desaturase gene (EgD5; SEQ ID NO:54) from pDMW367, previously described in PCT Publication No. WO 2007/136877 published Nov. 29, 2007 (the contents of which are hereby incorporated by reference), labeled with $P^{32}$. Colony lifts were probed, positives were identified and confirmed and DNA was isolated and sequenced exactly as described in Example 19.

A representative clone containing a cDNA (pLF119) is shown in SEQ ID NO:105 and the gene contained within the cDNA was called EaD5Des1. The coding sequence for EaD5Des1 is shown in SEQ ID NO:106. The corresponding amino acid sequence for EaD5Des1 is shown in SEQ ID NO:107.

Example 21

Construction of Soybean Expression Vector pKR1183 for Expression of a *Euglena anabaena* Delta-9 Elongase-*Tetruetreptia pomquetensis* CCMP1491 Delta-8 Desaturase Fusion Gene (Hybrid1-HGLA Synthase)

An in-frame fusion between the *Euglena anabaena* delta-9 elongase (EaD9Elo1; SEQ ID NO:101), the *Euglena gracilis* DHAsynthase 1 proline-rich linker (EgDHAsyn1Link; SEQ ID NO:97) and the *Tetruetreptia pomquetensis* CCMP1491 delta-8 desaturase (TpomD8; SEQ ID NO:50; Example 5; see also Applicants' Assignee's co-pending application having U.S. patent application Ser. No. 11/876,115 (filed Oct. 22, 2007)) was constructed using the conditions described below.

An initial in-frame fusion between the EaD9Elo1 and the EgDHAsyn1Link (EaD9elo-EgDHAsyn1Link) was made, flanked by an NcoI site at the 5'end and a NotI site at the 3' end, by PCR amplification. EaD9Elo1 (SEQ ID NO:101) was amplified from pLF121-1 (SEQ ID NO:99) with oligonucleotides EaD9-5Bbs (SEQ ID NO:108) and EaD9-3fusion (SEQ ID NO:109), using the Phusion™ High-Fidelity DNA Polymerase (Cat. No. F553S, Finnzymes Oy, Finland) following the manufacturer's protocol. EgDHAsyn1Link (SEQ ID NO:97) was amplified in a similar way from pKR1049 (Example 18) with oligonucleotides EgDHAsyn1Link-5fusion (SEQ ID NO:110) and MWG511 (SEQ ID NO:111). The two resulting PCR products were combined and re-amplified using EaD9-5Bbs (SEQ ID NO:108) and MWG511 (SEQ ID NO:111) to form EaD9Elo1-EgDHAsyn1Link. The sequence of the EaD9Elo1-EgDHAsyn1Link is shown in SEQ ID NO:112. EaD9Elo1-EgDHAsyn1Link does not contain an in-frame stop codon upstream of the NotI site at the 3' end and therefore, a DNA fragment cloned into the NotI site can give rise to an in-frame fusion with the EgD9elo-EgDHAsyn1Link if the correct frame is chosen. EaD9Elo1-EgDHAsyn1Link was cloned into the pCR-Blunt® cloning vector using the Zero Blunt® PCR Cloning Kit (Invitrogen Corporation), following the manufacturer's protocol, to produce pLF124 (SEQ ID NO:113).

Plasmid KS366 (SEQ ID NO:114) contains unique NcoI and NotI restriction sites, flanked by the promoter for the α' subunit of β-conglycinin (Beachy et al., *EMBO J.* 4:3047-3053 (1985)) and the 3' transcription termination region of the phaseolin gene (Doyle et al., *J. Biol. Chem.* 261:9228-9238 (1986)). Other than the replacement of the unique NotI site in pKR72 (SEQ ID NO:67) with a unique NcoI/NotI multiple cloning site, the Bcon/NcoINotI/Phas3' cassette in KS366 is identical to that found in pKR72 (SEQ ID NO:67), except that the flanking HindIII sites were replaced by BamHI sites. The Bcon/NcoINotI/Phas3' cassette of KS366 is cloned into the BamHI site of pBluescript II SK(+) vector (Stratagene).

The BbsI/NotI DNA fragment of pLF124 (SEQ ID NO:113), containing EaD9Elo1-EgDHAsyn1Link, was cloned into the NcoI/NotI DNA fragment from KS366 (SEQ ID NO:114), containing the promoter for the α' subunit of β-conglycinin, to produce pKR1177 (SEQ ID NO:115).

The BamHI DNA fragment of pKR1177 (SEQ ID NO:115), containing EaD9Elo1-EgDHAsyn1Link, was cloned into the BamHI DNA fragment of pKR325, previously described in PCT Publication No. WO 2006/012325 (the contents of which are hereby incorporated by reference) to produce pKR1179 (SEQ ID NO:116).

Figure 19:
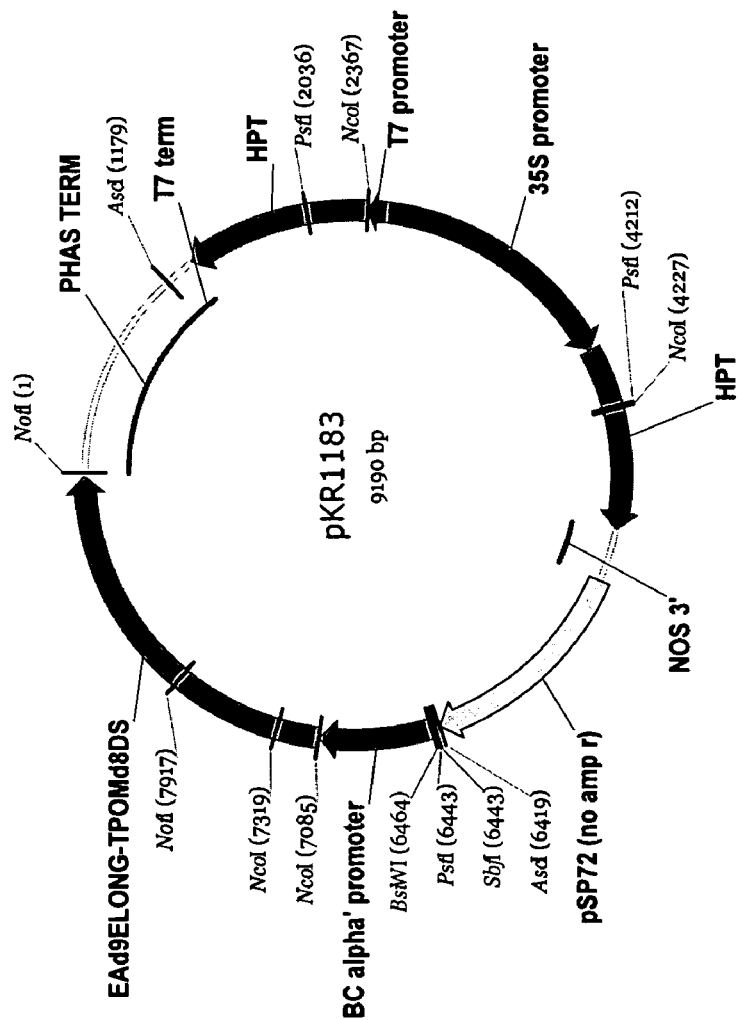
FIG. 19 is a map of plasmid pKR1183.

The NotI fragment from pLF114-10 (Example 5; SEQ ID NO:64), containing TpomD8 was cloned into the NotI fragment of pKR1179 (SEQ ID NO:116) to produce pKR1183 (SEQ ID NO:117; FIG. 19). In FIG. 19, the fusion gene (Hybrid1-HGLA synthase) is called EAd9ELONG-TPOMd8DS.

Example 22

Construction of Soybean Expression Vector pKR1253 for Expression of a *Euglena anabaena* delta-9 Elongase-*Tetruetreptia pomquetensis* CCMP1491 Delta-8 Desaturase Fusion Gene (Hybrid1-HGLA Synthase) with a *Euglena gracilis* delta-5 Desaturase Through a number of subcloning steps, a NotI site was added to the 5' end of the *Euglena gracilis* delta-5 desaturase (EgD5; SEQ ID NO:54) from pDMW367 (Example 20) and this NotI fragment containing EgD5 was cloned into the NotI site of pKR457 (SEQ ID NO:2) to produce pKR1237 (SEQ ID NO:118).

The AscI fragment of pKR1183 (SEQ ID NO:117; Example 21), containing the Hybrid1-HGLA synthase, was cloned into the AscI fragment of pKR277 (SEQ ID NO:4, which was previously described in PCT Publication No. WO 2004/071467 (the contents of which are hereby incorporated by reference)) to produce pKR1252 (SEQ ID NO:119).

Figure 20:
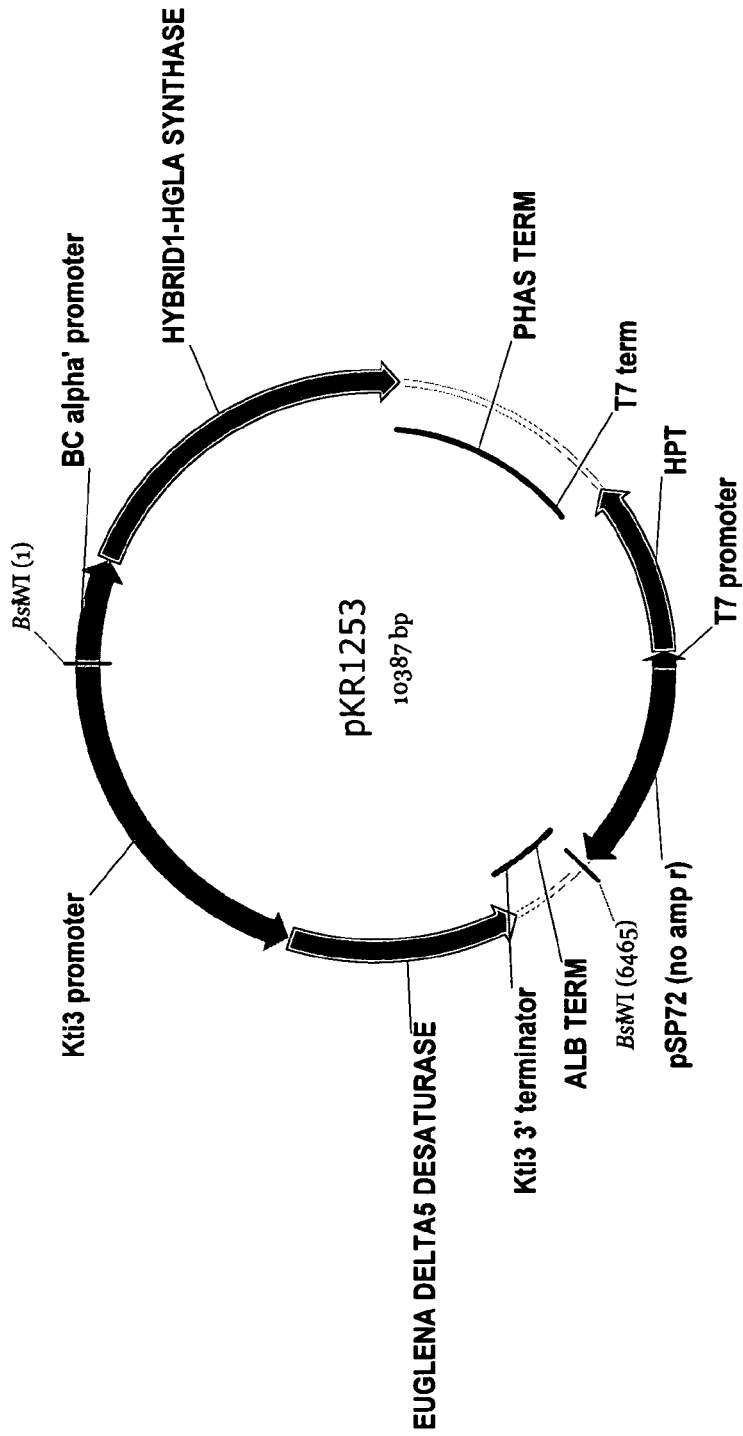
FIG. 20 is a map of plasmid pKR1253.

The BsiWI fragment of pKR1237 (SEQ ID NO:118), containing the EgD5 gene, was cloned into the BsiWI site of pKR1252 (SEQ ID NO:119) to produce pKR1253 (SEQ ID NO:120; FIG. 20).

Example 23

Construction of Soybean Vector pKR1139 for Expression of a *Euglena anabaena* Delta-5 Desaturase The present Example describes the cloning of a delta-5 desaturase from *Euglena anabaena* UTEX 373 into a soybean expression vector. This work is also described in U.S. Provisional Application No. 60/915,733 filed May 3, 2007) the contents of which are hereby incorporated by reference).

EaD5Des1 (SEQ ID NO:101) was amplified from pLF119 (SEQ ID NO:105, Example 20) with oEAd5-1-1 (SEQ ID NO:121) and oEAd5-1-2 (SEQ ID NO:122), using the Phusion™ High-Fidelity DNA Polymerase (Cat. No. F553S, Finnzymes Oy, Finland) following the manufacturer's protocol. The resulting PCR product was cloned into the pCR-Blunt® cloning vector using the Zero Blunt® PCR Cloning Kit (Invitrogen Corporation), following the manufacturer's protocol, to produce pKR1136 (SEQ ID NO:123).

The NotI fragment for pKR1136 (SEQ ID NO:123) containing the EaD5Des1 was cloned into the NotI fragment of pKR974, previously described in PCT Publication No. WO 2007/136877 published Nov. 29, 2007 (the contents of which are hereby incorporated by reference), to produce pKR1139 (SEQ ID NO:124).

Example 24

Figure 21:
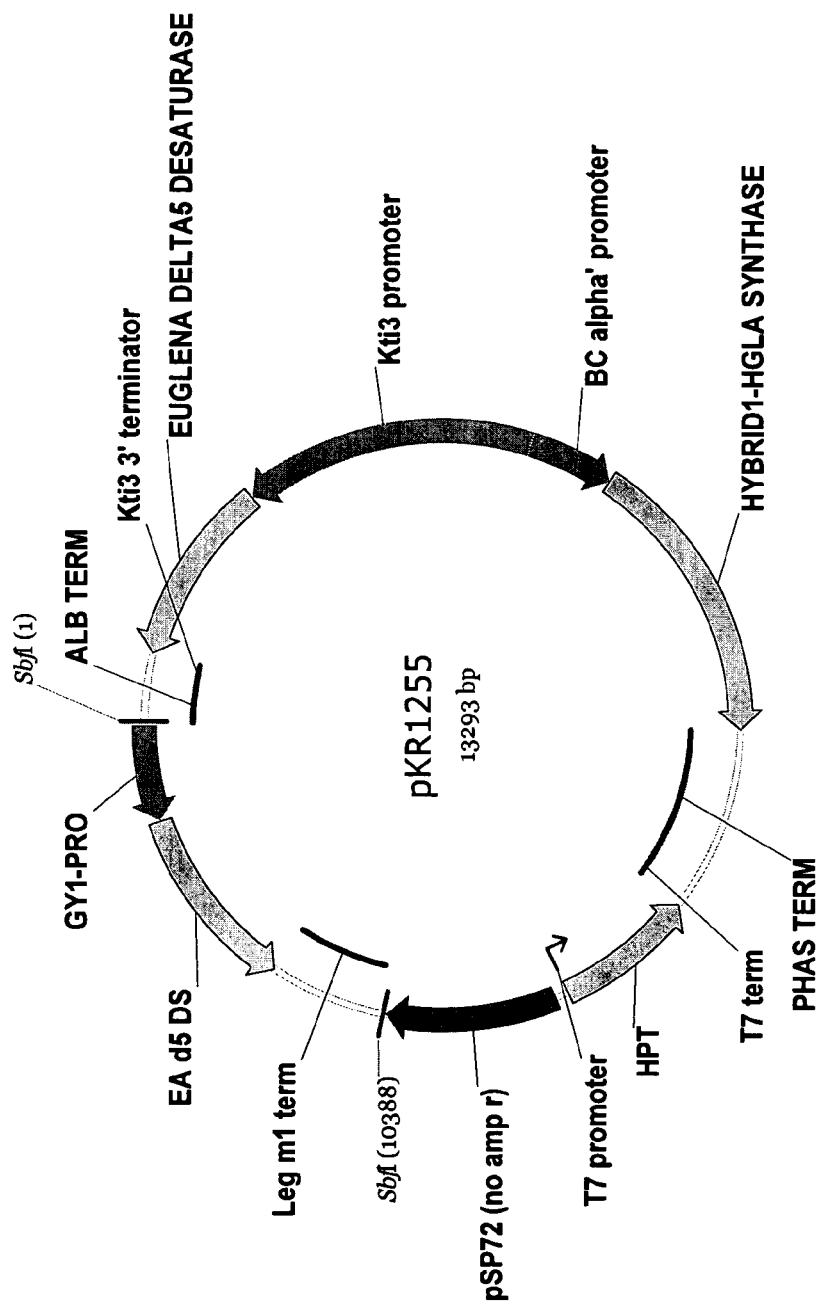
FIG. 21 is a map of plasmid pKR1255.

Construction of Soybean Expression Vector pKR1255 for Expression of a *Euglena anabaena* delta-9 Elongase-*Tetruetreptia pomquetensis* CCMP1491 Delta-8 Desaturase Fusion Gene (Hybrid1-HGLA Synthase) with a *Euglena gracilis* delta-5 Desaturase and a *Euglena anabaena* delta-5 Desaturase Plasmid pKR1139 (SEQ ID NO:124; Example 23) was digested with SbfI and the fragment containing the EaD5Des1 was cloned into the SbfI site of pKR1253 (SEQ ID NO:120; Example 22) to produce pKR1255 (SEQ ID NO:76; FIG. 21).

Example 25

Construction of Soybean Expression Vector pKR1189 for Down-Regulating Expression of Soybean Fad3

In a way similar to that described in Example 11, a soybean expression vector was designed to decrease fad3 expression in soybean.

A starting vector pKR561 (SEQ ID NO:125) was assembled by inserting the BsiWI fragment of pKR268 (SEQ ID NO:15; Example 7) containing the annexin promoter into the BsiWI site of pKR145, which is described in PCT Publication No. WO 04/071467).

A portion of the 5' end of the fad3 gene was amplified from XF1 (described in Example 8) with the Phusion™ High-Fidelity DNA Polymerase (Cat. No. F553S, Finnzymes Oy, Finland) following the manufacturer's protocol, using HPfad3-1 (SEQ ID NO:30) and HPfad3-2 (SEQ ID NO:31) to produce a DNA fragment called HPfad3AB (SEQ ID NO:32).

A portion of the 3' end of the fad3 gene was amplified from XF1 (described in Example 8) with the Phusion™ High-Fidelity DNA Polymerase, using HPfad3-3 (SEQ ID NO:33) and HPfad3-1 (SEQ ID NO:30) to produce a DNA fragment called HPfad3A'-2 (SEQ ID NO:126).

HPfad3AB and HPfad3A'-2 were combined and amplified using the Phusion™ High-Fidelity DNA Polymerase with HPfad3-1 (SEQ ID NO:30) to produce HPfad3ABA'-2 (SEQ ID NO:127). HPfad3ABA'-2 (SEQ ID NO:127) is almost identical to HPfad3ABA' (SEQ ID NO:36) but has a NotI site at both the 5' and 3' end of the DNA fragment. The resulting PCR product was cloned into the pCR-Blunt® cloning vector using the Zero Blunt® PCR Cloning Kit (Invitrogen Corporation), following the manufacturer's protocol, to produce pLF129 (SEQ ID NO:128).

Figure 22:
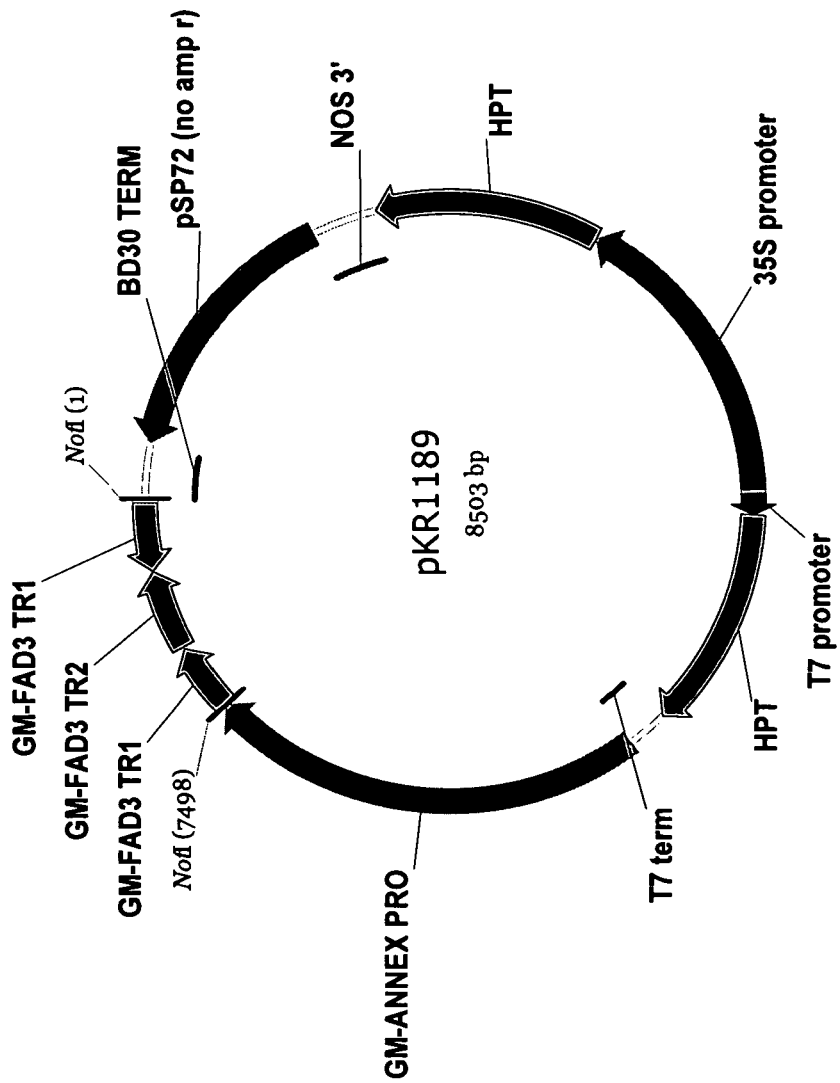
FIG. 22 is a map of plasmid pKR1189.

The NotI fragment for pLF129 (SEQ ID NO:128) containing the fad3 hairpin was cloned into the NotI fragment of pK561 (SEQ ID NO:125) to produce pKR1189 (SEQ ID NO:129; FIG. 22). In FIG. 22, the A and A' domains for fad3 are indicated by the designation TR1 while the B domain is indicated by TR2.

Example 26

Construction of Soybean Expression Vector pKR1249 for Down-Regulating Soybean Fad3 and Soybean Fad3c The NotI/HindIII fragment of pLF129 (SEQ ID NO:128) containing the TR1 and TR2 domains of fad3, as indicated in FIG. 22, was cloned into the NotI/HindIII backbone fragment of pLF129 (SEQ ID NO:128) to produce pKR1209 (SEQ ID NO:130).

The coding sequence of GmFad3C (GenBank Accession No. AY204712) (Bilyeu et al., *Crop Sci.* 43:1833-1838 (2003); Anai et al., *Plant Sci.* 168:1615-1623 (2005)) is shown in SEQ ID NO:131 and the corresponding amino acid sequence is shown in SEQ ID NO:132. A portion of the fad3c gene was amplified from the soybean cDNA library described in PCT Publication No. WO 93/11245 (which was published on Jun. 10, 1993; also U.S. Pat. No. 5,952,544) (the contents of which are hereby incorporated by reference) with the Phusion™ High-Fidelity DNA Polymerase (Cat. No. F553S, Finnzymes Oy, Finland) following the manufacturer's protocol, using fad3c-5 (SEQ ID NO:133) and fad3c-3 (SEQ ID NO:134). The resulting DNA fragment was cloned into the pCR-Blunt® cloning vector using the Zero Blunt® PCR Cloning Kit (Invitrogen Corporation), following the manufacturer's protocol, to produce pKR1213 (SEQ ID NO:135).

The EcoRV/XhoI fragment of pKR1213 (SEQ ID NO:135) containing the fragment of fad3c was cloned into the NotI (filled)/XhoI site of pKR1209 (SEQ ID NO:130) to produce pKR1218 (SEQ ID NO:136).

The NotI/HindIII fragment of pLF129 (SEQ ID NO:128) containing the TR1 domain only from fad3, as indicated in FIG. 22, was cloned into the NotI/HindIII backbone fragment of pLF129 (SEQ ID NO:128) to produce pKR1210 (SEQ ID NO:137).

The EcoRV/XhoI fragment of pKR1213 (SEQ ID NO:135) containing the fragment of fad3c was cloned into the NotI (filled)/XhoI site of pKR1210 (SEQ ID NO:137) to produce pKR1219 (SEQ ID NO:138).

The XhoI(filled)/HindIII fragment of pKR1218 (SEQ ID NO:136) containing the fragment of fad3c as well as fad3 TR1 and TR2 domains was cloned into the MluI(filled)/HindIII site of pKR1219 (SEQ ID NO:138), containing the fragment of fad3c as well as the fad3 TR1 only domain, to produce pKR1225 (SEQ ID NO:139). In this way, a new hairpin including fad3 and fad3c and flanked by NotI sites was formed.

Figure 23:
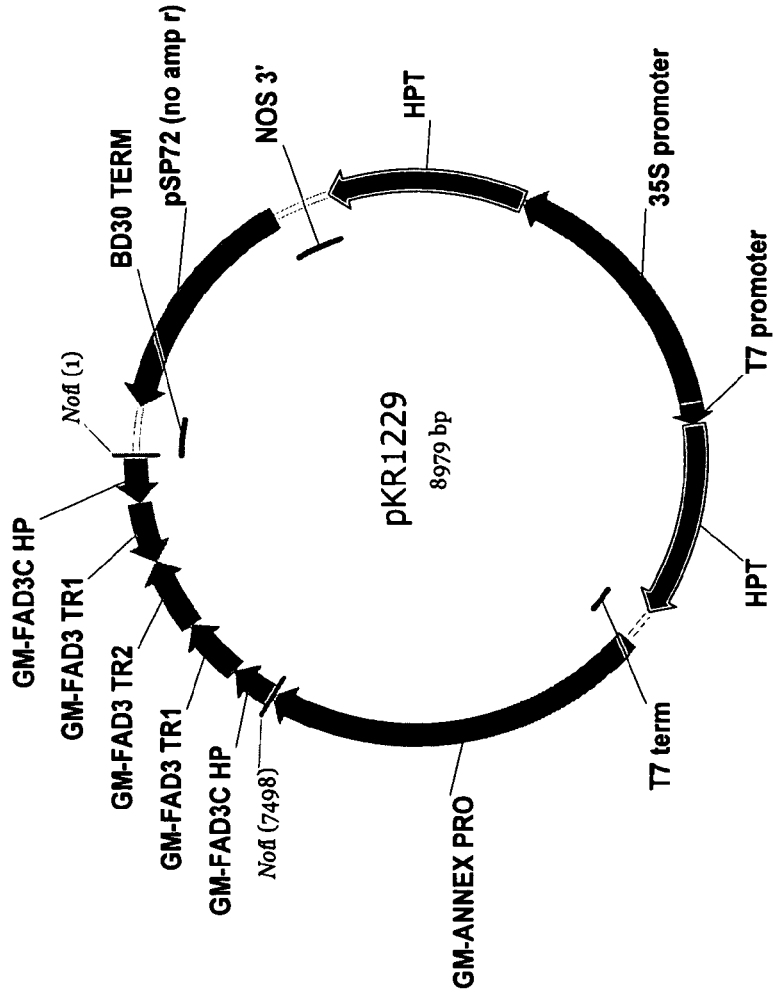
FIG. 23 is a map of plasmid pKR1229.

The NotI fragment for pKR1225 (SEQ ID NO:139) containing the new hairpin including fad3 and fad3c was cloned into the NotI fragment of pK561 (SEQ ID NO:125; Example 24) to produce pKR1229 (SEQ ID NO:140; FIG. 23). In this way, the fad3/fad3c hairpin can be expressed from a strong, seed-specific promoter with hygromycin selection in plants.

Figure 24:
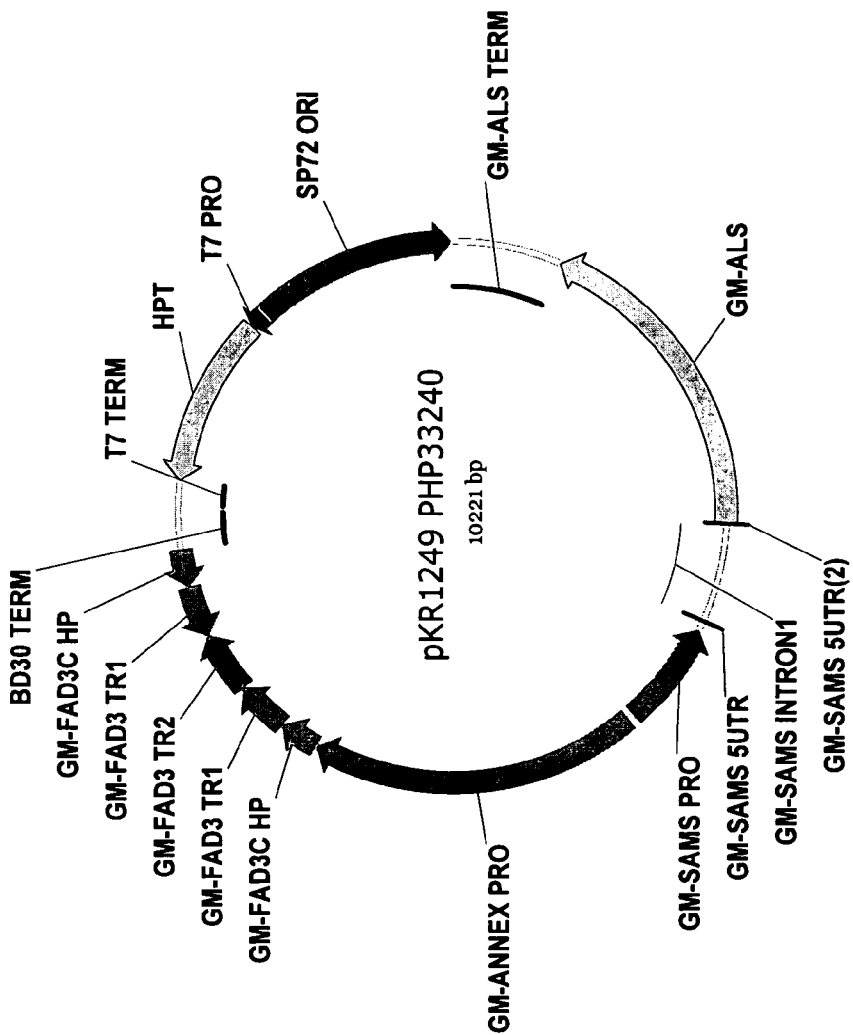
FIG. 24 is a map of plasmid pKR1249.

The BsiWI fragment for pKR1225 (SEQ ID NO:139) containing the new hairpin including fad3 and fad3c was cloned into the BsiWI fragment of pKR226 (SEQ ID NO:9; Example 6) to produce pKR1249 (SEQ ID NO:141; FIG. 24). In FIG. 24, pKR1249 is labeled pKR1249_PHP33240. In this way, the fad3/fad3c hairpin can be expressed from a strong, seed-specific promoter with chlorsulfuron (ALS) selection in plants.

Example 27

Identification of a Delta-8 Desaturase from *Euglena anabaena* UTEX 373

The present Example describes the identification and cloning of a delta-8 desaturase from *Euglena anabaena* UTEX 373. This work is also described in U.S. Provisional Application No. 60/910,831 (filed Apr. 10, 2007), the contents of which are hereby incorporated by reference).

Identification of cDNA Fragments Encoding Partial Putative Delta-8 Desaturases:

The plasmid DNA sub-library of eug1c described in Example 19 was used as template for degenerate PCR using degenerate primers based on the nucleotide sequence of the *Euglena gracilis* delta-8 fatty acid desaturase (SEQ ID NO:142) and the vector-specific primer pDonor222Eg5-1 (SEQ ID NO:143). The 4 degenerate primers used are shown in Table 10.

TABLE 10

Degenerate Oligonucleotides Used to Amplify a Portion of the Delta-8 Desaturase Genes From *Euglena anabaena* UTEX 373

| Primer | Nucleotide Sequence | SEQ ID NO: |
|---|---|---|
| D8DEG3-1 | RTTRTGNCKATCTTTCCACCA | SEQ ID NO: 144 |
| D8DEG3-2 | RTTRTGNCKGTCTTTCCACCA | SEQ ID NO: 145 |
| D8DEG3-3 | RTTRTGNCKATCCTTCCACCA | SEQ ID NO: 146 |
| D8DEG3-4 | RTTRTGNCKGTCCTTCCACCA | SEQ ID NO: 147 |

A total of 5 reactions were set up for the cDNA sample. The reaction mixture contained 1 μL of cDNA, 1 μL each of the vector-specific and degenerate primer (20 μM) and the PCR was carried out using the Phusion™ High-Fidelity DNA Polymerase (Cat. No. F553S, Finnzymes Oy, Finland) following the manufacturer's protocol. The resulting DNA fragments were cloned into the pCR-Blunt® cloning vector using the Zero Blunt® PCR Cloning Kit (Invitrogen Corporation), following the manufacturer's protocol.

Plasmid DNA from the resulting clones was purified using the QIAprep® Spin Miniprep Kit (Qiagen Inc.) following the manufacturer's protocol and DNA inserts were end-sequenced and sequences analyzed as described in Example 18 and 19.

A consensus sequence was assembled from the individual sequences obtained and one representative clone, called pHD23-1 (SEQ ID NO:148) having a sequence identical to the consensus was chosen for further study.

The BLASTX search using the nucleotide sequence insert from pHD23-1 revealed similarity of the protein encoded by the partial cDNA to the *Euglena gracilis* delta-8 desaturase amino acid sequence (SEQ ID NO:149) (NCBI Accession No. AAD45877 (GI 5639724), locus AAD45877, CDS AF139720; Wallis and Browse, *Arch. Biochem. Biophys.* 365: 307-316 (1999)) and yielded a p Log value of 63.4 (E value of 4e-63).

Isolation of the Full-Length Delta-8 Desaturases from *Euglena anabaena* UTEX 373:

Amplified cDNA library euglc was plated and colonies lifted as described in Example 19.

A DNA probe was made using an agarose gel purified EcoRI DNA fragment, containing the *Euglena anabaena* delta-8 desaturase partial DNA fragment, from pHD23-1 labeled with $P^{32}$ dCTP. Colony lifts were probed, positives were identified and confirmed and DNA was isolated and sequenced exactly as described in Example 19.

Sequences were aligned and compared using Sequencher™ (Version 4.2, Gene Codes Corporation, Ann Arbor, Mich.) and in this way, the clones could be categorized into one of four distinct groups based on insert sequence (called EaD8Des1 to EaD8Des4). The sequence for one representative clone containing EaD8Des3 (pLF118-3) is shown in SEQ ID NO:150. The sequence shown by a string of NNNN's represents a region of the polyA tail which was not sequenced. The coding and amino acid sequences for EaD8Des3 are shown in SEQ ID NO:151 SEQ ID NO:152, respectively.

In order to introduce NotI and NcoI restriction sites at the 5' end of the coding sequences and a NotI site at the 3' end of the coding sequences, EaD8Des3 (SEQ ID NO:151) was amplified from pLF118-3 (SEQ ID NO:15) with oligonucleotide primers EaD8-5 (SEQ ID NO:153) and EaD8-3 (SEQ ID NO:154) using the Phusion™ High-Fidelity DNA Polymerase (Cat. No. F553S, Finnzymes Oy, Finland) following the manufacturer's protocol. The resulting DNA fragment was cloned into the pCR-Blunt® cloning vector using the Zero Blunt® PCR Cloning Kit (Invitrogen Corporation), following the manufacturer's protocol, to produce pLF120-3 (SEQ ID NO:155).

Example 28

Construction of Soybean Expression Vector pKR1140 for Expression of *Euglena anabaena* UTEX 373 Delta-9 Elongase (EaD9Elo1)

The present Example describes construction of a soybean vector for expression of EaD9Elo1. This work is also described in U.S. Provisional Application No. 60/911,925 (filed Apr. 16, 2007, the contents of which are hereby incorporated by reference).

In order to introduce NotI and NcoI restriction sites at the 5' end of the coding sequences and a NotI site at the 3' end of the coding sequences, EaD9Elo1 was PCR amplified. The coding sequence for EaD9Elo1 (SEQ ID NO:101) was amplified from pLF121-1 (SEQ ID NO:99) with oligonucleotide primers oEAd9el1-1 (SEQ ID NO:156) and oEAd9el1-2 (SEQ ID NO:157) using the Phusion™ High-Fidelity DNA Polymerase (Cat. No. F553S, Finnzymes Oy, Finland) following the manufacturer's protocol. The resulting DNA fragments were cloned into the pCR-Blunt® cloning vector using the Zero Blunt® PCR Cloning Kit (Invitrogen Corporation), following the manufacturer's protocol, to produce pKR1137 (SEQ ID NO:158).

EaD9Elo1 was released from pKR1137 (SEQ ID NO:158) by digestion with NotI and cloned into the NotI site of pKR72 (SEQ ID NO:67) to produce pKR1140 (SEQ ID NO:159).

Example 29

Construction of an *Arabidopsis* Expression Vector pKR1193 for Expression of a *Euglena anabaena* Delta-9 Elongase with a *Euglena anabaena* Delta-8 Desaturase and a *Euglena anabaena* Delta-5 Desaturase The AscI fragment of pKR1140 (SEQ ID NO:159) was cloned into the AscI fragment of pKR277 (SEQ ID NO:4) to produce pKR1173 (SEQ ID NO:160).

The Gy1/Pavelo/legA2 cassette was released from plasmid pKR336 (described in PCT Publication Nos. WO 04/071467; the contents of which are hereby incorporated by reference) by digestion with PstI/BamHI and cloned into the PstI/BamHI site of pKR268 (described in PCT Publication Nos. WO 04/071467) to produce pKR393 (SEQ ID NO:161). The Pavelo gene was released from pKR393 (SEQ ID NO:161) by digestion with NotI and the vector was re-ligated to from pKR407 (SEQ ID NO:162).

The NotI fragment from pLF120-3 (SEQ ID NO:155), containing EaD8Des3 was cloned into the NotI fragment of pKR407 (SEQ ID NO:162) to produce pKR1176 (SEQ ID NO:163).

The PstI fragment from pKR1176 (SEQ ID NO:163), containing EaD8Des3 was cloned into the SbfI fragment of pKR1173 (SEQ ID NO:160) to produce pKR1178 (SEQ ID NO:164).

The βcon/NotI/Phas cassette was PCR amplified from pKS123, which is described in PCT Publication No.s WO 2004/071467 and WO 02/008269 (the contents of which are hereby incorporated by reference) using primers oKti5 (SEQ ID NO:165) and oKti6 (SEQ ID NO:166). The resulting PCR fragment was digested with BsiWI and cloned into the BsiWI site of pKR124 (which is described in PCT Publication No. WO 2004/071467 and the contents of which are hereby incorporated by reference), containing the bacterial origin of replication and selection, to produce plasmid pKR193 (SEQ ID NO:167).

The NotI fragment from pKR1136 (SEQ ID NO:122; Example 23), containing EaD5Des1 was cloned into the NotI fragment of pKR193 (SEQ ID NO:167) to produce pKR1174 (SEQ ID NO:168).

The BsiWI fragment for pKR1174 (SEQ ID NO:168) containing EaD5Des1 was cloned into the BsiWI fragment of pKR1178 (SEQ ID NO:164) to produce pKR1186 (SEQ ID NO:169).

Figure 25:
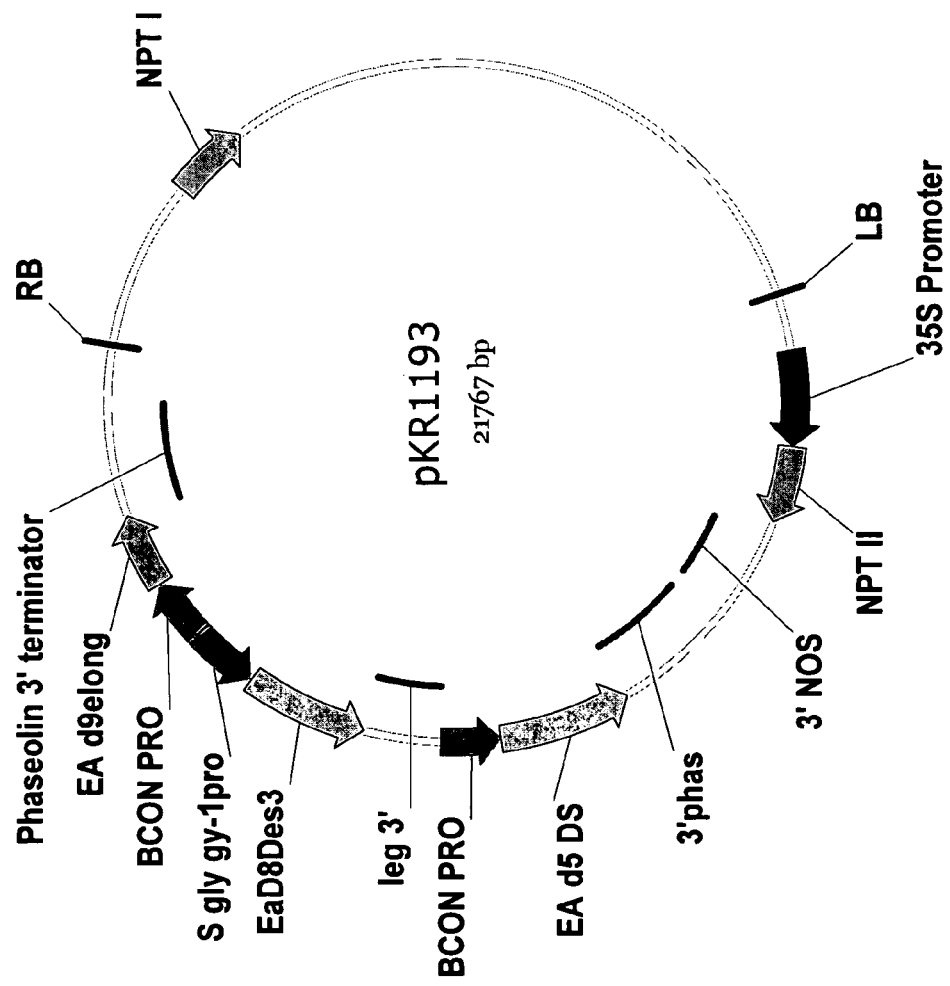
FIG. 25 is a map of plasmid pKR1193.

The AscI fragment of pKR1186 (SEQ ID NO:169), containing EaD9elo1, etc was cloned into the AscI site of pKR92 (which was previously described in WO2007/061845 published on May 31, 2007 to produce pKR1193 (SEQ ID NO:170). A schematic depiction of pKR1193 is shown in FIG. 25. In this way, EaD9Elo1 and EaD5Des1 were expressed in *Arabidopsis* under control of the soybean beta-conglycinin promoter and the EaD8Des3 was expressed under control of the soybean glycinin Gy1 promoter. The soybean beta-conglycinin promoter and Gy1 promoter function as a strong, seed-specific promoters in *Arabidopsis*.

Example 30

Down-Regulation of the Soybean fad3 and fad3c Genes in Soybean Somatic Embryos by Transformation with pKR1189 or pKR1229

The present Example describes the transformation and expression in soybean somatic embryos of pKR1189 (SEQ ID NO:129, Example 25), containing a fad3 hairpin construct or pKR1229 (SEQ ID NO:140; Example 26), containing a fad3 and fad3c hairpin construct. Both constructs also have the hygromycin phosphoptransferase gene for selection on hygromycin.

Soybean embryogenic suspension culture (cv. Jack) was transformed with pKR1189 (SEQ ID NO:129) or pKR1229 (SEQ ID NO:140) and embryos were matured in soybean histodifferentiation and maturation liquid medium (SHaM liquid media; Schmidt et al., Cell Biology and Morphogenesis, 24:393 (2005)) as previously described in PCT Publication No. WO 2007/136877 published Nov. 29, 2007 (the contents of which are hereby incorporated by reference).

After maturation in SHaM liquid media, individual embryos were removed from the clusters, dried and screened for alterations in their fatty acid compositions as described in Example 2. In each case, a subset of soybean embryos (i.e., five embryos per event) transformed with either pKR1189 (SEQ ID NO:129) or pKR1229 (SEQ ID NO:140) were harvested and analyzed.

In this way, 41 events transformed with pKR1189 (SEQ ID NO:129; Experiment 2148) or pKR1229 (SEQ ID NO:140; Experiment 2165) were analyzed. The fatty acid profiles for the five events having the lowest average ALA content (average of the 5 embryos analyzed) along with an event (2148-3-8-1) having a fatty acid profile typical of wild type embryos for this experiment, are shown in FIG. 26. In FIG. 26, fatty acids are identified as 16:0 (palmitate), 18:0 (stearic acid), 18:1 (oleic acid), LA, and ALA and fatty acid compositions are expressed as a weight percent (wt. %) of total fatty acids.

ALA content in somatic embryos expressing either a fad3 hairpin construct (event number 2148, FIG. 26) or a fad3 and fad3c hairpin construct (event number 2165, FIG. 26) showed at least a 50% reduction when compared to typical wild type embryos (FIG. 26). This strongly indicates that either hairpin construct is functional to decrease ALA content in soybean embryos.

Example 31

Soybean Somatic Embryos Transformed with pKR1183 for Expression of a *Euglena anabaena* Delta-9 Elongase-*Tetruetreptia pomquetensis* CCMP1491 Delta-8 Desaturase Fusion Gene (Hybrid1-HGLA Synthase)

The present Example describes the transformation and expression in soybean somatic embryos of pKR1183 (SEQ ID NO:117) containing the *Euglena anabaena* delta-9 elongase-*Tetruetreptia pomquetensis* CCMP1491 Delta-8 Desaturase Fusion Gene (Hybrid1-HGLA Synthase) and the hygromycin phosphoptransferase gene for selection on hygromycin.

Soybean embryogenic suspension culture (cv. Jack) was transformed with pKR1183 (SEQ ID NO:117) and embryos were matured in soybean histodifferentiation and maturation liquid medium (SHaM liquid media; Schmidt et al., Cell Biology and Morphogenesis, 24:393 (2005)) as previously described in PCT Publication No. WO 2007/136877 published Nov. 29, 2007 (the contents of which are hereby incorporated by reference).

After maturation in SHaM liquid media a subset of soybean embryos (i.e., four embryos per event) transformed with pKR1183 (SEQ ID NO:117) were harvested and analyzed as described herein.

In this way, 20 events transformed with pKR1183 (SEQ ID NO:117; Experiment 2145) were analyzed. The fatty acid profiles for the five events having the highest average DGLA content (average of the 5 embryos analyzed) are shown in FIG. 27. In FIG. 27, fatty acids are identified as 16:0 (palmitate), 18:0 (stearic acid), 18:1 (oleic acid), LA, ALA, EDA, ERA, DGLA and ETA and fatty acid compositions are expressed as a weight percent (wt. %) of total fatty acids.

Example 32

Soybean Embryos Transformed with Soybean Expression Vectors pKR1253 for Expression of a *Euglena anabaena* Delta-9 Elongase-*Tetruetreptia pomquetensis* CCMP1491 Delta-8 Desaturase Fusion Gene (Hybrid1-HGLA Synthase) with a *Euglena gracilis* Delta-5 Desaturase and pKR1249 for Down-Regulating Soybean Fad3 and Soybean Fad3c Soybean embryogenic suspension culture (cv. Jack) was transformed with the AscI fragments of pKR1249 (SEQ ID NO:141; Example 26) and pKR1253 (SEQ ID NO:120) as described in Example 1. A subset of soybean embryos generated from each event (ten embryos per event) were harvested, picked into glass GC vials and fatty acid methyl esters (FAMEs) were prepared by transesterification and analyzed by GC as described in Example 2. Retention times were compared to those for methyl esters of standards commercially available (Nu-Chek Prep, Inc.).

In this way, 142 events transformed with pKR1249 (SEQ ID NO:141; Example 26) and pKR1253 (SEQ ID NO:120) (experiment called Heal 25) were analyzed. From the 142 events analyzed, 90 were identified that produced ARA in at least one embryo out of ten analyzed at a relative abundance greater than 1.0% of the total fatty acids. Of these, 64 were identified that produced ARA in at least one embryo out of ten analyzed at a relative abundance greater than 10.0% of the total fatty acids. And of these, 44 events were identified that produced ARA in at least one embryo out of ten analyzed at a relative abundance greater than 20.0% of the total fatty acids.

The average fatty acid profiles (Average of 10 embryos) for 20 events having the highest ARA are shown in FIG. 28. Fatty acids are identified as 16:0 (palmitate), 18:0 (stearic acid), 18:1 (oleic acid), LA, ALA, EDA, SCI, DGLA, ARA, ERA, JUN, ETA and EPA; and, fatty acid compositions listed in FIG. 28 are expressed as a weight percent (wt. %) of total fatty acids. For FIG. 28, fatty acids listed as "others" include: 18:2

(5,9), 18:3 (5,9,12), STA, 20:0, 20:1(11), 20:2 (7,11) or 20:2 (8,11) and DPA. Each of these fatty acids is present at a relative abundance of less than 2.0% of the total fatty acids. Average total omega-3 fatty acid (Total n-3) is the sum of the averages of all omega-3 fatty acids).

The actual fatty acid profiles for each embryo from one event (AFS 5416-8-1-1) having an average ARA content of 17.0% and average EPA content of 1.5% is shown in FIG. 29. Fatty acids are identified as 16:0 (palmitate), 18:0 (stearic acid), 18:1 (oleic acid), LA, ALA, EDA, SCI, DGLA, ARA, ERA, JUN, ETA and EPA; and, fatty acid compositions listed in FIG. 29 are expressed as a weight percent (wt. %) of total fatty acids. For FIG. 29, fatty acids listed as "others" include: 18:2 (5,9), 18:3 (5,9,12), STA, 20:0, 20:1(11), 20:2 (7,11) or 20:2 (8,11) and DPA. Each of these fatty acids is present at a relative abundance of less than 2.0% of the total fatty acids. Total omega-3 fatty acid (Total n-3) is the sum of all omega-3 fatty acids).

Because ALA content is generally 1.5- to 3-fold higher in soybean somatic embryos than it is in seed (ie, 15%-30% in embryos (see for example typical WT embryo in FIG. 26), depending on maturation conditions and time, versus 7-10% in a seed (Bilyeu et al., 2005, Crop Sci. 45:1830-1836)) it is expected that omega-3 contents in general and EPA contents specifically, will be significantly lower in seed than somatic embryos.

Example 33

Soybean Embryos Transformed with Soybean Expression Vectors pKR1255 for Expression of a Euglena anabaena Delta-9 Elongase-*Tetruetreptia pomquetensis* CCMP1491 Delta-8 Desaturase Fusion Gene (Hybrid1-HGLA Synthase) with a *Euglena gracilis* Delta-5 Desaturase and a *Euglena anabaena* Delta-5 Desaturase and pKR1249 for Down-Regulating Soybean Fad3 and Soybean Fad3c Soybean embryogenic suspension culture (cv. Jack) was transformed with the AscI fragments of pKR1249 (SEQ ID NO:141; Example 26) and pKR1255 (SEQ ID NO:124) as described in Example 1. A subset of soybean embryos generated from each event (ten embryos per event) were harvested, picked into glass GC vials and fatty acid methyl esters (FAMEs) were prepared by transesterification and analyzed by GC as described in Example 2. Retention times were compared to those for methyl esters of standards commercially available (Nu-Chek Prep, Inc.).

In this way, 197 events transformed with pKR1249 (SEQ ID NO:141; Example 26) and pKR1255 (SEQ ID NO:124) (experiment called Heal 26) were analyzed. From the 197 events analyzed, 128 were identified that produced ARA in at least one embryo out of ten analyzed at a relative abundance greater than 1.0% of the total fatty acids. Of these, 105 were identified that produced ARA in at least one embryo out of ten analyzed at a relative abundance greater than 10.0% of the total fatty acids. And of these, 83 events were identified that produced ARA in at least one embryo out of ten analyzed at a relative abundance greater than 20.0% of the total fatty acids.

The average fatty acid profiles (Average of 9 or 10 embryos) for 20 events having the highest ARA are shown in FIG. 30. Fatty acids are identified as 16:0 (palmitate), 18:0 (stearic acid), 18:1 (oleic acid), LA, ALA, EDA, SCI, DGLA, ARA, ERA, JUN, ETA and EPA; and, fatty acid compositions listed in FIG. 30 are expressed as a weight percent (wt. %) of total fatty acids. For FIG. 30, fatty acids listed as "others" include: 18:2 (5,9), 18:3 (5,9,12), STA, 20:0, 20:1(11), 20:2 (7,11) or 20:2 (8,11) and DPA. Each of these fatty acids is present at a relative abundance of less than 2.0% of the total fatty acids. Average total omega-3 fatty acid (Total n-3) is the sum of the averages of all omega-3 fatty acids).

Example 34

Functional Analysis of *Arabidopsis* Seed Transformed with pKR1193 for Expression of a *Euglena anabaena* Delta-9 Elongase with a *Euglena anabaena* Delta-8 Desaturase and a *Euglena anabaena* Delta-5 Desaturase in *Arabidopsis*

A fad3/fae1 double mutant (Smith et al., Planta 217:507-516 (2003)) of *Arabidopsis* produces seed where the ALA and 20:1 fatty acid content is less than 2.0%. The fad3/fae1 double mutant *Arabidopsis* plants were transformed with pKR1193 (SEQ ID NO:170), and plants were grown, maintained and seed was harvested as previously described in WO 2007/061845, which published May 31, 2007 (the contents of which are hereby incorporated by reference)).

Segregating T2 seed was obtained from 18 individual events for each and bulk T2 seed lipid profiles for each event were obtained by transesterification with TMSH as described in Example 2 with the following modifications. For each event, a small scoopful of seeds (approximately 25-50 seed each scoopful) was crushed in 50 µL of TMSH in a 1.5 mL eppendorf tube. After shaking in TMSH for 15 min., 400 µL of heptane was added and the tubes were vortexed well, shaken for an additional 15 min and centrifuged at 13,000×g for 1 min. After shaking, the heptane layer was removed into glass GC vials and the fatty acid methyl esters were analyzed as described in Example 2.

The lipid profiles of T2 bulk seed for the 19 transformed events is shown in FIG. 31. Fatty acids are identified as 16:0 (palmitate), 18:0 (stearic acid), 18:1 (oleic acid), LA, ALA, 20:1 (eicosenoic acid), EDA, DGLA, ERA ETA and EPA; and, fatty acid compositions listed in FIG. 31 are expressed as a weight percent (wt. %) of total fatty acids. For FIG. 31, fatty acids listed as "others" include: 18:2 (5,9), 18:3 (5,9,12), STA, 20:0 (arachidic acid), 20:2 (7,11) or 20:2 (8,11), SCI and JUP. Each of these fatty acids is present at a relative abundance of less than 2.0% of the total fatty acids.

Individual T2 seed lipid profiles (ten seed per event) for two fad3/fae1-transformed events (i.e., ff1194-16 & 'ff1194-18), having a bulk ARA content of 10.4% and 9.4%, respectively (FIG. 31) were obtained by transesterification with TMSH as described herein but with the following modifications. One seed was crushed in 10 µL of TMSH in a 1.5 mL eppendorf tube. After shaking in TMSH for 15 min, 75 µL of heptane was added and the tubes were vortexed well, shaken for an additional 15 min and centrifuged at 13,000×g for 1 min. After centrifugation, the heptane layer was removed into glass GC vials containing 200 µL inserts and the fatty acid methyl esters were analyzed as described in Example 31.

The lipid profiles of individual seed are shown in FIG. 32. Fatty acids are identified as 16:0 (palmitate), 18:0 (stearic acid), 18:1 (oleic acid), LA, GLA, ALA, STA, 20:1 (eicosenoic acid), EDA, DGLA, ERA, ETA and EPA and DPA; and, fatty acid compositions listed in FIG. 32 are expressed as a weight percent (wt. %) of total fatty acids. For FIG. 32, fatty acids listed as "others" include: 18:3 (5,9,12), 20:0 (arachidic acid), 20:2 (7,11) or 20:2 (8,11) & 22:0. Each of these fatty acids is present at a relative abundance of less than 3.0% of the total fatty acids.

SEQUENCE LISTING (172 sequences)

SEQ ID NO: 1 - DNA, 5671 bp, Artificial Sequence
  plasmid KS129
ggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttggatccgtcgacggcgcgcccgatcatccggatatagttcctcctttcagcaaaaaacccctcaagacccgtttagaggccccaaggggttatgctagttattgctcagcggtggcagcagccaactcagcttcctttcgggctttgttagcagccggatcgatccaagctgtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggcttttccatgggtatatctccttcttaaagttaaacaaaattatttctagagggaaaccgttgtggtctccctatagtgagtcgtattaatttcgcgggatcgagatctgatcaacctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatggacatattgtcgttagaacgcggctacaattaatacataaccttatgtatcatacacatacgatttaggtgacactatagaacggcgcgccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcatgggaacggaccaaggaaaaaccttcacctgggaagagctggcggcccataacaccaaggacgacctactcttggccatccgcggcagggtgtacgatgtcacaaagttcttgagccgccatcctggtggagtggacactctcctgctcggagctggccgagatgttactccggtctttgagatgtatcacgcgtttggggctgcagatgccattatgaagaagtactatgtcggtacactggtctcgaatgagctgcccatcttcccggagccaacggtgttccacaaaaccatcaagacgagagtcgagggctactttacggatcggaacattgatcccaagaatagaccagagatctggggacgatacgctcttatctttggatccttgatcgcttcctactacgcgcagctctttgtgcctttcgttgtcgaacgcacatggcttcaggtggtgtttgcaatcatcatgggatttgcgtgcgcacaagtcggactcaaccctcttcatgatgcgtctcacttttcagtgacccacaaccccactgtctggaagattctgggagccacgcacgactttttcaacggagcatcgtacctggtgtggatgtaccaacatatgctcggccatcacccctacaccaacattgctggagcagatcccgacgtgtcgacgtctgagcccgatgttcgtcgtatcaagcccaaccaaaagtggtttgtcaaccacatcaaccagcacatgtttgttcctttcctgtacggactgctggcgttcaaggtgcgcattcaggacatcaacattttgtactttgtcaagaccaatgacgctattcgtgtcaatcccatctcgacatggcacactgtgatgttctggggcggcaaggctttctttgtctggtatcgcctgattgttcccctgcagtatctgcccctgggcaaggtgctgctcttgttcacggtcgcggacatggtgtcgtcttactggctggcgctgaccttccaggcgaaccacgttgttgaggaagttcagtggccgttgcctgacgagaacgggatcatccaaaaggactgggcagctatgcaggtcgagactacgcaggattacgcacacgattcgcacctctggaccagcatcactggcagcttgaactaccaggctgtgcaccatctgttccccaacgtgtcgcagcaccattatcccgatattctggccatcatcaagaacacctgcagcgagtacaaggttccataccttgtcaaggatacgttttggcaagcatttgcttcacatttggagcacttgcgtgttcttggactccgtcccaaggaagagtaggc

SEQ ID NO: 2 - DNA, 5252 bp, Artificial Sequence
  plasmid pKR457
  misc_feature (3872)..(3872): n is a, c, g, or t
gtacgtgggcggatcccccgggctgcaggaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttgcatgcctgcaggtcgactcgacgtacgtcctcgaagagaagggttaataacacattttttaacatttttaacacaaattttagttatttaaaaatttattaaaaaatttaaaataagaagaggaactctttaaataaatctaacttacaaaatttatgatttttaataagttttcaccaataaaaaatgtcataaaaatatgttaaaaagtatattatcaatattctctttatgataaataaaaagaaaaaaaaaataaaagttaagtgaaaatgagattgaagtgactttaggtgtgtataaatatatcaaccccgccaacaatttatttaatccaaatatattgaagtatattattccatagcctttatttatttatatatttattatataaaagctttatttgttctaggttgttcatgaaatatttttttggttttatctccgttgtaagaaaatcatgtgctttgtgtcgccactcactattgcagctttttcatgcattggtcagattgacggttgattgtatttttgttttttatggttttgtgttatgacttaagtcttcatctctttatctcttcatcaggtttgatggttacctaatatggtccatgggtacatgcatggttaaattaggtggccaactttgttgtgaacgatagaattttttttatattaagtaaactatttttatattatgaaataataataaaaaaaatattttatcattattaacaaaatcatattagttaatttgttaactctataataaaagaaatactgtaacattcacattacatggtaacatctttccaccctttcatttgttttttgtttgatgactttttttcttgtttaaatttatttcccttcttttaaatttggaatacattatcatcatatataaactaaaatactaaaaacaggattacacaaatgataaataataacacaaatatttataaatctagctgcaatatatttaaactagctatatcgatattgtaaaataaaactagctgcattgatactgataaaaaaatatcatgtgctttctggactgatgatgcagtatacttttgacattgcctttattttatttttcagaaaagctttcttagttctgggttcttcattatttgtttcccatctccattgtgaattgaatcatttgcttcgtgtcacaaatacaatttagntaggtacatgcattggtcagattcacggtttattatgtcatgacttaagttcatggtagtacattacctgccacgcatgcattatattggttagatttgataggcaaatttggttgtcaacaatataaatataaataatgtttttatattacgaaataacagtgatcaaaacaaacagttttatctttattaacaagattttgtttttgtttgatgacgttttttaatgtttacgctttcccccttcttttgaatttagaacactttatcatcataaaatcaaatactaaaaaaattacatatttcataaataataacacaaatatttttaaaaaatctgaaataataatgaacaatattacatattatcacgaaaattcattaataaaaatattatataaataaaatgtaatagtagttatatgtaggaaaaaagtactgcacgcataatatatacaaaaagattaaaatgaactattataaataataacactaaattaatggtgaatcatatcaaaataatgaaaaagtaaataaaatttgtaattaacttctatatgtattacacacacaaataataaataatagtaaaaaaaattatgataaatatttaccatctcataagatatttaaaataatgataaaaatatagattattttttatgcaactagctagccaaaaagagaacacgggtatatataaaaagagtacctttaaattctactgtacttcctttattcctgacgtttttatatcaagtggacatacgtgaagattttaattatcagtctaaatatttcattagcacttaatacttttctgttttattcctatcctataagtagtcccgattctcccaacattgcttattcacacaactaactaagaaagtcttccatagccccccaagcggccgcgacacaagtgtgagagtactaaataaatgctttggttgtacgaaatcattacactaaataaaataatcaaagcttatatatgccttccgctaaggccgaatgcaaagaaattggttctttctcgttatcttttgccacttttactagtacgtattaattactacttaatcatctttgtttacggctcattatatccggtctagaggatccaaggccgcgaagttaaaagcaatgttgtcacttgtcgtactaacacatgatgtgatagtttatgctagctagctataacataagctgtctctgagtgtgttgtatattaataaagatcatcactggtgaatggtgatcgtgtacgtaccctacttagtaggcaatggaagcacttagagtgtgctttgtgcatggccttgcctctgttttgagacttttgtaatgttttcgagtttaaatctttgcctttgc

SEQ ID NO: 3 - DNA, 6601 bp, Artificial Sequence
  plasmid pKR606
  misc_feature (5689)..(5689): n is a, c, g, or t
ggccgcatgggaacggaccaaggaaaaaccttcacctgggaagagctggcggcccataacaccaaggacgacctactcttggccatccgcggcagggtgtacgatgtcacaaagttcttgagccgccatcctggtggagtggacactctcctgctcggagctggccgagatgttactccggtctttgagatgtatcacgcgtttggggctgcagatgccattatgaagaagtactatgtcggtacactggtctcgaatgagctgcccatcttcccggagccaacggtgttccacaaaaccatcaagacgagagtcgagggctactttacggatcggaacattgatcccaagaatagaccagagatctggggacgatacgctcttatctttggatccttgatcgcttcctactacgcgcagctctttgtgcctttcgttgtcgaacgcacatggcttcaggtggtgtttgcaatcatcatgggatttgcgtgcgcacaagtcggactcaaccctcttcatgatgcgtctcacttttcagtgacccacaaccccactgtctggaagattctgggagccacgcacgactttttcaacggagcatcgtacctggtgtggatgtaccaacatatgctcggccatcacccctacaccaacattgctggagcagatcccgacgtgtcgacgtctgagcccgatgttcgtcgtatcaagcccaaccaaaagtggtttgtcaaccacatcaaccagcacatgtttgttcctttcctgtacggactgctggcgttcaaggtgcgcattcaggacatcaacattttgtactttgtcaagaccaatgacgctattcgtgtcaatcccatctcgacatggcacactgtgatgttctggggcggcaaggctttctttgtctggtatcgcctgattgttcccctgcagtatctgcccctgggcaaggtgctgctcttgttcacggtcgcggacatggtgtcgtcttactggctggcgctgaccttccaggcgaaccacgttgttgaggaagttcagtggccgttgcctgacgagaacgggatcatccaaaaggactgggcagctatgcaggtcgagactacgcaggattacgcacacgattcgcacctctggaccagcatcactggcagcttgaactaccaggctgtgcaccatctgttccccaacgtgtcgcagcaccattatcccgatattctggccatcatcaagaacacctgcagcgagtacaaggttccataccttgtcaaggatacgttttggcaagcatttgcttcacatttggagcacttgcgtgttcttggactccgtcccaaggaagagtaggcggccgcgacacaagtgtgagagtactaaataaatgctttggttgtacgaaatcattacactaaataaaataatcaaagcttatatatgccttccgctaaggccgaatgcaaagaaattggttctttctcgttatcttttgccacttttactagtacgtattaattactacttaatcatctttgtttacggctcattatatccggtctagaggatccaaggccgcgaagttaaaagcaatgttgtcacttgtcgtactaacacatgatgtgatagtttatgctagctagctataacataagctgtctctgagtgtgttgtatattaataaagatcatcactggtgaatggtgatcgtgtacgtaccctacttagtaggcaatggaagcacttagagtgtgctttgtgcatggccttgcctctgttttgagacttttgtaatgttttcgagtttaaatctttgcctttgcgtacgtgggcggatcccccgggctgcaggaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttgcatgcctgcaggtcgactcgacgtacgtcctcgaagagaagggttaataacacattttttaacatttttaacacaaattttagttatttaaaaatttattaaaaaatttaaaataagaagaggaactctttaaataaatctaacttacaaaatttatgatttttaataagttttcaccaataaaaaatgtcataaaaatatgttaaaaagtatattatcaatattctctttatgataaataaaaagaaaaaaaaaataaaagttaagtgaaaatgagattgaagtgactttaggtgtgtataaatatatcaaccccgccaacaatttatttaatccaaatatattgaagtatattattccatagcctttatttatttatatatttattatataaaagctttatttgttctaggttgttcatgaaatatttttttggttttatctccgttgtaagaaaatcatgtgctttgtgtcgccactcactattgcagctttttcatgcattggtcagattgacggttgattgtatttttgttttttatggttttgtgttatgacttaagtcttcatctctttatctcttcatcaggtttgatggttacctaatatggtccatgggtacatgcatggttaaattaggtggccaactttgttgtgaacgatagaattttttttatattaagtaaactatttttatattatgaaataataataaaaaaaatattttatcattattaacaaaatcatattagttaatttgttaactctataataaaagaaatactgtaacattcacattacatggtaacatctttccaccctttcatttgttttttgtttgatgactttttttcttgtttaaatttatttcccttcttttaaatttggaatacattatcatcatatataaactaaaatactaaaaacaggattacacaaatgataaataataacacaaatatttataaatctagctgcaatatatttaaactagctatatcgatattgtaaaataaaactagctgcattgatactgataaaaaaatatcatgtgctttctggactgatgatgcagtatacttttgacattgcctttattttatttttcagaaaagctttcttagttctgggttcttcattatttgtttcccatctccattgtgaattgaatcatttgcttcgtgtcacaaatacaatttagntaggtacatgcattggtcagattcacggtttattatgtcatgacttaagttcatggtagtacattacctgccacgcatgcattatattggttagatttgataggcaaatttggttgtcaacaatataaatataaataatgtttttatattacgaaataacagtgatcaaaacaaacagttttatctttattaacaagattttgtttttgtttgatgacgttttttaatgtttacgctttcccccttcttttgaatttagaacactttatcatcataaaatcaaatactaaaaaaattacatatttcataaataataacacaaatatttttaaaaaatctgaaataataatgaacaatattacatattatcacgaaaattcattaataaaaatattatataaataaaatgtaatagtagttatatgtaggaaaaaagtactgcacgcataatatatacaaaaagattaaaatgaactattataaataataacactaaattaatggtgaatcatatcaaaataatgaaaaagtaaataaaatttgtaattaacttctatatgtattacacacacaaataataaataatagtaaaaaaaattatgataaatatttaccatctcataagatatttaaaataatgataaaaatatagattattttttatgcaactagctagccaaaaagagaacacgggtatatataaaaagagtacctttaaattctactgtacttcctttattcctgacgtttttatatcaagtggacatacgtgaagattttaattatcagtctaaatatttcattagcacttaatacttttctgttttattcctatcctataagtagtcccgattctcccaacattgcttattcacacaactaactaagaaagtcttccatagccccccaagc

SEQ ID NO: 4 - DNA, 2577 bp, Artificial Sequence
  plasmid pKR277
agcttggatctcctgcaggatctggccggccggatctcgtacggatccgtcgacggcgcgcccgatcatccggatatagttcctcctttcagcaaaaaacccctcaagacccgtttagaggccccaaggggttatgctagttattgctcagcggtggcagcagccaactcagcttcctttcgggctttgttagcagccggatcgatccaagctgtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggcttttccatgggtatatctccttcttaaagttaaacaaaattatttctagagggaaaccgttgtggtctccctatagtgagtcgtattaatttcgcgggatcgagatctgatcaacctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatggacatattgtcgttagaacgcggctacaattaatacataaccttatgtatcatacacatacgatttaggtgacactatagaacggcgcgcca

SEQ ID NO: 5 - DNA, 6494 bp, Artificial Sequence
  plasmid pKR804
  misc_feature (3761)..(3761): n is a, c, g, or t
ccggccggatctcgtacggatccgtcgacggcgcgcccgatcatccggatatagttcctcctttcagcaaaaaacccctcaagacccgtttagaggccccaaggggttatgctagttattgctcagcggtggcagcagccaactcagcttcctttcgggctttgttagcagccggatcgatccaagctgtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggcttttccatgggtatatctccttcttaaagttaaacaaaattatttctagagggaaaccgttgtggtctccctatagtgagtcgtattaatttcgcgggatcgagatctgatcaacctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatggacatattgtcgttagaacgcggctacaattaatacataaccttatgtatcatacacatacgatttaggtgacactatagaacggcgcgccaagcttggatctcctgcaggatctggccgggtacgtcctcgaagagaagggttaataacacattttttaacatttttaacacaaattttagttatttaaaaatttattaaaaaatttaaaataagaagaggaactctttaaataaatctaacttacaaaatttatgatttttaataagttttcaccaataaaaaatgtcataaaaatatgttaaaaagtatattatcaatattctctttatgataaataaaaagaaaaaaaaaataaaagttaagtgaaaatgagattgaagtgactttaggtgtgtataaatatatcaaccccgccaacaatttatttaatccaaatatattgaagtatattattccatagcctttatttatttatatatttattatataaaagctttatttgttctaggttgttcatgaaatatttttttggttttatctccgttgtaagaaaatcatgtgctttgtgtcgccactcactattgcagctttttcatgcattggtcagattgacggttgattgtatttttgttttttatggttttgtgttatgacttaagtcttcatctctttatctcttcatcaggtttgatggttacctaatatggtccatgggtacatgcatggttaaattaggtggccaactttgttgtgaacgatagaattttttttatattaagtaaactatttttatattatgaaataataataaaaaaaatattttatcattattaacaaaatcatattagttaatttgttaactctataataaaagaaatactgtaacattcacattacatggtaacatctttccaccctttcatttgttttttgtttgatgactttttttcttgtttaaatttatttcccttcttttaaatttggaatacattatcatcatatataaactaaaatactaaaaacaggattacacaaatgataaataataacacaaatatttataaatctagctgcaatatatttaaactagctatatcgatattgtaaaataaaactagctgcattgatactgataaaaaaatatcatgtgctttctggactgatgatgcagtatacttttgacattgcctttattttatttttcagaaaagctttcttagttctgggttcttcattatttgtttcccatctccattgtgaattgaatcatttgcttcgtgtcacaaatacaatttagntaggtacatgcattggtcagattcacggtttattatgtcatgacttaagttcatggtagtacattacctgccacgcatgcattatattggttagatttgataggcaaatttggttgtcaacaatataaatataaataatgtttttatattacgaaataacagtgatcaaaacaaacagttttatctttattaacaagattttgtttttgtttgatgacgttttttaatgtttacgctttcccccttcttttgaatttagaacactttatcatcataaaatcaaatactaaaaaaattacatatttcataaataataacacaaatatttttaaaaaatctgaaataataatgaacaatattacatattatcacgaaaattcattaataaaaatattatataaataaaatgtaatagtagttatatgtaggaaaaaagtactgcacgcataatatatacaaaaagattaaaatgaactattataaataataacactaaattaatggtgaatcatatcaaaataatgaaaaagtaaataaaatttgtaattaacttctatatgtattacacacacaaataataaataatagtaaaaaaaattatgataaatatttaccatctcataagatatttaaaataatgataaaaatatagattattttttatgcaactagctagccaaaaagagaacacgggtatatataaaaagagtacctttaaattctactgtacttcctttattcctgacgtttttatatcaagtggacatacgtgaagattttaattatcagtctaaatatttcattagcacttaatacttttctgttttattcctatcctataagtagtcccgattctcccaacattgcttattcacacaactaactaagaaagtcttccatagccccccaagcggccgcatgggaacggaccaaggaaaaaccttcacctgggaagagctggcggcccataacaccaaggacgacctactcttggccatccgcggcagggtgtacgatgtcacaaagttcttgagccgccatcctggtggagtggacactctcctgctcggagctggccgagatgttactccggtctttgagatgtatcacgcgtttggggctgcagatgccattatgaagaagtactatgtcggtacactggtctcgaatgagctgcccatcttcccggagccaacggtgttccacaaaaccatcaagacgagagtcgagggctactttacggatcggaacattgatcccaagaatagaccagagatctggggacgatacgctcttatctttggatccttgatcgcttcctactacgcgcagctctttgtgcctttcgttgtcgaacgcacatggcttcaggtggtgtttgcaatcatcatgggatttgcgtgcgcacaagtcggactcaaccctcttcatgatgcgtctcacttttcagtgacccacaaccccactgtctggaagattctgggagccacgcacgactttttcaacggagcatcgtacctggtgtggatgtaccaacatatgctcggccatcacccctacaccaacattgctggagcagatcccgacgtgtcgacgtctgagcccgatgttcgtcgtatcaagcccaaccaaaagtggtttgtcaaccacatcaaccagcacatgtttgttcctttcctgtacggactgctggcgttcaaggtgcgcattcaggacatcaacattttgtactttgtcaagaccaatgacgctattcgtgtcaatcccatctcgacatggcacactgtgatgttctggggcggcaaggctttctttgtctggtatcgcctgattgttcccctgcagtatctgcccctgggcaaggtgctgctcttgttcacggtcgcggacatggtgtcgtcttactggctggcgctgaccttccaggcgaaccacgttgttgaggaagttcagtggccgttgcctgacgagaacgggatcatccaaaaggactgggcagctatgcaggtcgagactacgcaggattacgcacacgattcgcacctctggaccagcatcactggcagcttgaactaccaggctgtgcaccatctgttccccaacgtgtcgcagcaccattatcccgatattctggccatcatcaagaacacctgcagcgagtacaaggttccataccttgtcaaggatacgttttggcaagcatttgcttcacatttggagcacttgcgtgttcttggactccgtcccaaggaagagtaggcggccgcgacacaagtgtgagagtactaaataaatgctttggttgtacgaaatcattacactaaataaaataatcaaagcttatatatgccttccgctaaggccgaatgcaaagaaattggttctttctcgttatcttttgccacttttactagtacgtattaattactacttaatcatctttgtttacggctcattatatccggtctagaggatccaaggccgcgaagttaaaagcaatgttgtcacttgtcgtactaacacatgatgtgatagtttatgctagctagctataacataagctgtctctgagtgtgttgtatattaataaagatcatcactggtgaatggtgatcgtgtacgtaccctacttagtaggcaatggaagcacttagagtgtgctttgtgcatggccttgcctctgttttgagacttttgtaatgttttcgagtttaaatctttgcctttgcgtac

SEQ ID NO: 6 - DNA, 4771 bp, Artificial Sequence
  plasmid pKR953
ggccgcgaagttaaaagcaatgttgtcacttgtcgtactaacacatgatgtgatagtttatgctagctagctataacataagctgtctctgagtgtgttgtatattaataaagatcatcactggtgaatggtgatcgtgtacgtaccctacttagtaggcaatggaagcacttagagtgtgctttgtgcatggccttgcctctgttttgagacttttgtaatgttttcgagtttaaatctttgcctttgcgtacgtctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcgagctcggtacccggggatcctctagacctgcaggccaactgcgtttggggctccagattaaacgacgccgtttcgttcctttcgcttcacggcttaacgatgtcgtttctgtctgtgcccaaaaaataaaggcatttgttatttgcaccagatatttactaagtgcaccctagtttgacaagtaggcgataattacaaatagatgcggtgcaaataataaattttgaaggaaataattacaaaagaacagaacttatatttactttattttaaaaaactaaaatgaaagaacaaaaaaagtaaaaaatacaaaaaatgtgctttaaccactttcattatttgttacagaaagtatgattctactcaaattgatctgttgtatctggtgctgccttgtcacactggcgatttcaatcccctaaagatatggtgcaaactgcgaagtgatcaatatctgctcggttaatttagattaattaataatattcaacgtgatgtaccaaaaaaagacaattttttgctccattgacaaattaaacctcatcaaggtaatttccaaacctataagcaaaaaaatttcacattaattggcccgcaatcctattagtcttattatactagagtaggaaaaaaaacaattacacaacttgtcttattattctctatgctaatgaatatttttcccttttgttagaaatcagtgtttcctaatttattgagtattaattccactcaccgcatatatttaccgttgaataagaaaattttacacataattctttttaagataaataatttttttatactagatcttatatgattacgtgaagccaagtgggttatactaatgatatataatgtttgatagtaatcagtttataaaccaaatgcatggaaatgttacgtggaagcacgtaaattaacaagcattgaagcaaatgcagccaccgcaccaaaaccaccccacttcacttccacgtaccatattccatgcaactacaacaccctaaaacttcaataaatgcccccaccttcacttcacttcacccatcaatagcaagcggccgcaccatggaggtggtgaatgaaatagtctcaattgggcaggaagttttacccaaagttgattatgcccaactctggagtgatgccagtcactgtgaggtgctttacttgtccatcgcatttgtcatcttgaagttcactcttggcccccttggtccaaaaggtcagtctcgtatgaagtttgttttcaccaattacaaccttctcatgtccatttattcgttgggatcattcctctcaatggcatatgccatgtacaccatcggtgttatgtctgacaactgcgagaaggcttttgacaacaacgtcttcaggatcaccacgcagttgttctatttgagcaagttcctggagtatattgactccttctatttgccactgatgggcaagcctctgacctggttgcaattcttccatcatttgggggcaccgatggatatgtggctgttctataattaccgaaatgaagctgtttggatttttgtgctgttgaatggtttcatccactggatcatgtacggttattattggaccagattgatcaagctgaagttccccatgccaaaatccctgattacatcaatgcagatcattcaattcaatgttggtttctacattgtctggaagtacaggaacattccctgttatcgccaagatgggatgaggatgtttggctggttcttcaattacttttatgttggcacagtcttgtgtttgttcttgaatttctatgtgcaaacgtatatcgtcaggaagcacaagggagccaaaaagattcagtgagc

SEQ ID NO: 7 - DNA, 8584 bp, Artificial Sequence
  plasmid pKR1084
  misc_feature (5299)..(5299): n is a, c, g, or t
ggagatccaagcttggcgcgccgttctatagtgtcacctaaatcgtatgtgtatgatacataaggttatgtattaattgtagccgcgttctaacgacaatatgtccatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcaggttgatcagatctcgatcccgcgaaattaatacgactcactatagggagaccacaacggtttccctctagaaataattttgtttaactttaagaaggagatatacccatggaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacagcttggatcgatccggctgctaacaaagcccgaaaggaagctgagttggctgctgccaccgctgagcaataactagcataaccccttggggcctctaaacgggtcttgaggggttttttgctgaaaggaggaactatatccggatgatcgggcgcgccgtcgacggatccgtacgagatccggccgggtacgcaaaggcaaagatttaaactcgaaaacattacaaaagtctcaaaacagaggcaaggccatgcacaaagcacactctaagtgcttccattgcctactaagtagggtacgtacacgatcaccattcaccagtgatgatctttattaatatacaacacactcagagacagcttatgttatagctagctagcataaactatcacatcatgtgttagtacgacaagtgacaacattgcttttaacttcgcggccttggatcctctagaccggatataatgagccgtaaacaaagatgattaagtagtaattaatacgtactagtaaaagtggcaaaagataacgagaaagaaccaatttctttgcattcggccttagcggaaggcatatataagctttgattattttatttagtgtaatgatttcgtacaaccaaagcatttatttagtactctcacacttgtgtcgcggccgcctactcttccttgggacggagtccaagaacacgcaagtgctccaaatgtgaagcaaatgcttgccaaaacgtatccttgacaaggtatggaaccttgtactcgctgcaggtgttcttgatgatggccagaatatcgggataatggtgctgcgacacgttggggaacagatggtgcacagcctggtagttcaagctgccagtgatgctggtccagaggtgcgaatcgtgtgcgtaatcctgcgtagtctcgacctgcatagctgcccagtccttttggatgatcccgttctcgtcaggcaacggccactgaacttcctcaacaacgtggttcgcctggaaggtcagcgccagccagtaagacgacaccatgtccgcgaccgtgaacaagagcagcaccttgcccaggggcagatactgcaggggaacaatcaggcgataccagacaaagaaagccttgccgccccagaacatcacagtgtgccatgtcgagatgggattgacacgaatagcgtcattggtcttgacaaagtacaaaatgttgatgtcctgaatgcgcaccttgaacgccagcagtccgtacaggaaaggaacaaacatgtgctggttgatgtggttgacaaaccacttttggttgggcttgatacgacgaacatcgggctcagacgtcgacacgtcgggatctgctccagcaatgttggtgtaggggtgatggccgagcatatgttggtacatccacaccaggtacgatgctccgttgaaaaagtcgtgcgtggctcccagaatcttccagacagtggggttgtgggtcactgaaaagtgagacgcatcatgaagagggttgagtccgacttgtgcgcacgcaaatcccatgatgattgcaaacaccacctgaagccatgtgcgttcgacaacgaaaggcacaaagagctgcgcgtagtaggaagcgatcaaggatccaaagataagagcgtatcgtccccagatctctggtctattcttgggatcaatgttccgatccgtaaagtagccctcgactctcgtcttgatggttttgtggaacaccgttggctccgggaagatgggcagctcattcgagaccagtgtaccgacatagtacttcttcataatggcatctgcagccccaaacgcgtgatacatctcaaagaccggagtaacatctcggccagctccgagcaggagagtgtccactccaccaggatggcggctcaagaactttgtgacatcgtacaccctgccgcggatggccaagagtaggtcgtccttggtgttatgggccgccagctcttcccaggtgaaggtttttccttggtccgttcccatgcggccgcttggggggctatggaagactttcttagttagttgtgtgaataagcaatgttgggagaatcgggactacttataggataggaataaaacagaaaagtattaagtgctaatgaaatatttagactgataattaaaatcttcacgtatgtccacttgatataaaaacgtcaggaataaaggaagtacagtagaatttaaaggtactctttttatatatacccgtgttctctttttggctagctagttgcataaaaaataatctatatttttatcattattttaaatatcttatgagatggtaaatatttatcataattttttttactattatttattatttgtgtgtgtaatacatatagaagttaattacaaattttatttactttttcattattttgatatgattcaccattaatttagtgttattatttataatagttcattttaatctttttgtatatattatgcgtgcagtacttttttcctacatataactactattacattttatttatataatatttttattaatgaattttcgtgataatatgtaatattgttcattattatttcagattttttaaaaatatttgtgttattatttatgaaatatgtaatttttttagtatttgattttatgatgataaagtgttctaaattcaaaagaagggggaaagcgtaaacattaaaaaacgtcatcaaacaaaaacaaaatcttgttaataaagataaaactgtttgttttgatcactgttatttcgtaatataaaaacattatttatatttatattgttgacaaccaaatttgcctatcaaatctaaccaatataatgcatgcgtggcaggtaatgtactaccatgaacttaagtcatgacataataaaccgtgaatctgaccaatgcatgtacctanctaaattgtatttgtgacacgaagcaaatgattcaattcacaatggagatgggaaacaaataatgaagaacccagaactaagaaagcttttctgaaaaataaaataaaggcaatgtcaaaagtatactgcatcatcagtccagaaagcacatgatatttttttatcagtatcaatgcagctagttttattttacaatatcgatatagctagtttaaatatattgcagctagatttataaatatttgtgttattatttatcatttgtgtaatcctgtttttagtattttagtttatatatgatgataatgtattccaaatttaaaagaagggaaataaatttaaacaagaaaaaaagtcatcaaacaaaaaacaaatgaaagggtggaaagatgttaccatgtaatgtgaatgttacagtatttcttttattatagagttaacaaattaactaatatgattttgttaataatgataaaatattttttttattattatttcataatataaaaatagtttacttaatataaaaaaaattctatcgttcacaacaaagttggccacctaatttaaccatgcatgtacccatggaccatattaggtaaccatcaaacctgatgaagagataaagagatgaagacttaagtcataacacaaaaccataaaaaacaaaaatacaatcaaccgtcaatctgaccaatgcatgaaaaagctgcaatagtgagtggcgacacaaagcacatgattttcttacaacggagataaaaccaaaaaaatatttcatgaacaacctagaacaaataaagcttttatataataaatatataaataaataaaggctatggaataatatacttcaatatatttggattaaataaattgttggcggggttgatatatttatacacacctaaagtcacttcaatctcattttcacttaacttttattttttttttctttttatttatcataaagagaatattgataatatactttttaacatatttttatgacattttttattggtgaaaacttattaaaaatcataaattttgtaagttagatttatttaaagagttcctcttcttattttaaattttttaataaatttttaaataactaaaatttgtgttaaaaatgttaaaaaatgtgttattaacccttctcttcgaggacgtacccggccagatcctgcaggccaactgcgtttggggctccagattaaacgacgccgtttcgttcctttcgcttcacggcttaacgatgtcgtttctgtctgtgcccaaaaaataaaggcatttgttatttgcaccagatatttactaagtgcaccctagtttgacaagtaggcgataattacaaatagatgcggtgcaaataataaattttgaaggaaataattacaaaagaacagaacttatatttactttattttaaaaaactaaaatgaaagaacaaaaaaagtaaaaaatacaaaaaatgtgctttaaccactttcattatttgttacagaaagtatgattctactcaaattgatctgttgtatctggtgctgccttgtcacactggcgatttcaatcccctaaagatatggtgcaaactgcgaagtgatcaatatctgctcggttaatttagattaattaataatattcaacgtgatgtaccaaaaaaagacaattttttgctccattgacaaattaaacctcatcaaggtaatttccaaacctataagcaaaaaaatttcacattaattggcccgcaatcctattagtcttattatactagagtaggaaaaaaaacaattacacaacttgtcttattattctctatgctaatgaatatttttcccttttgttagaaatcagtgtttcctaatttattgagtattaattccactcaccgcatatatttaccgttgaataagaaaattttacacataattctttttaagataaataatttttttatactagatcttatatgattacgtgaagccaagtgggttatactaatgatatataatgtttgatagtaatcagtttataaaccaaatgcatggaaatgttacgtggaagcacgtaaattaacaagcattgaagcaaatgcagccaccgcaccaaaaccaccccacttcacttccacgtaccatattccatgcaactacaacaccctaaaacttcaataaatgcccccaccttcacttcacttcacccatcaatagcaagcggccgcaccatggaggtggtgaatgaaatagtctcaattgggcaggaagttttacccaaagttgattatgcccaactctggagtgatgccagtcactgtgaggtgctttacttgtccatcgcatttgtcatcttgaagttcactcttggcccccttggtccaaaaggtcagtctcgtatgaagtttgttttcaccaattacaaccttctcatgtccatttattcgttgggatcattcctctcaatggcatatgccatgtacaccatcggtgttatgtctgacaactgcgagaaggcttttgacaacaacgtcttcaggatcaccacgcagttgttctatttgagcaagttcctggagtatattgactccttctatttgccactgatgggcaagcctctgacctggttgcaattcttccatcatttgggggcaccgatggatatgtggctgttctataattaccgaaatgaagctgtttggatttttgtgctgttgaatggtttcatccactggatcatgtacggttattattggaccagattgatcaagctgaagttccccatgccaaaatccctgattacatcaatgcagatcattcaattcaatgttggtttctacattgtctggaagtacaggaacattccctgttatcgccaagatgggatgaggatgtttggctggttcttcaattacttttatgttggcacagtcttgtgtttgttcttgaatttctatgtgcaaacgtatatcgtcaggaagcacaagggagccaaaaagattcagtgagcggccgcgaagttaaaagcaatgttgtcacttgtcgtactaacacatgatgtgatagtttatgctagctagctataacataagctgtctctgagtgtgttgtatattaataaagatcatcactggtgaatggtgatcgtgtacgtaccctacttagtaggcaatggaagcacttagagtgtgctttgtgcatggccttgcctctgttttgagacttttgtaatgttttcgagtttaaatctttgcctttgcgtacgtctagagtcgacctgca

SEQ ID NO: 8 - DNA, 5754 bp, Artificial Sequence
  plasmid pKR1002
ggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacctgcaggtctagaggatccccgggtaccgagctcgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttgcatgcctgcaggtcgactctagacctgcaggatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcaccatgtctcctaagcggcaagctctgccaatcacaattgatggcgcaacttatgatgtgtctgcttgggtcaatcaccaccctggaggagctgacattatcgagaactatcgcaaccgcgatgcgaccgatgtcttcatggtgatgcactctcaagaagccgtcgccaagttgaagagaatgcctgttatggagccttcctctcctgacacacctgttgcacccaagcctaagcgtgatgagccccaggaggatttccgcaagttgcgggaggaattcatctccaagggtatgttcgagacgagtttcctttggtatttttacaagacttcaactaccgtcggtttgatggtcctttccatcttgatgaccgtgtacacgaattggtatttcaccgctgctttggttcttggcgtgtgctaccaacagctaggctggttgtcccacgactattgccatcaccaggttttcacaaaccgcaagattaacgacgctttcggtctctttttcggtaacgtgatgcagggatactcacagacttggtggaaggataggcacaatggtcaccatgccgccaccaatgtggtcggccatgacccagatattgataacctccccatcctggcttggtctcccgaagatgtcaagagggctactccttcgactcggaatctcatcaagtaccagcagtactacttcattcccaccattgcatcccttaggttcatctggtgcctccaatccatcggcggcgtcatgtcctacaagagcgaggagaggaacctgtactacaagcgccagtacactaaggaggcgattggtctggccctccactgggtgctcaaggccactttctattgcagtgccatgcctagctttgccaccggtttgggatgcttcttgatctccgagctgctcggaggatttggcattgccatcgttgtgtttctgaatcactatcctttggacaaggttgaggagactgtctgggatgagcacgggttcagcgccagccagatccacgagacgttgaacattaagcccggccttctcaccgattgggtctttggtggtctcaactaccagattgagcaccacttgtggcccaacatgcccaggcacaacctcacggcagcttccctggaggtgcagaagttgtgcgccaagcacaacctgccctacagggccccagccatcatccccggggttcagaaattggtcagcttcttaggcgagattgcccagctggctgctgtccctgaatgagc

SEQ ID NO: 9 - DNA, 6524 bp, Artificial Sequence
  plasmid pKR226
gtacgtctagaggatccgtcgacggcgcgcccgatcatccggatatagttcctcctttcagcaaaaaacccctcaagacccgtttagaggccccaaggggttatgctagttattgctcagcggtggcagcagccaactcagcttcctttcgggctttgttagcagccggatcgatccaagctgtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggcttttccatgggtatatctccttcttaaagttaaacaaaattatttctagagggaaaccgttgtggtctccctatagtgagtcgtattaatttcgcgggatcgagatctgatcaacctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatggacatattgtcgttagaacgcggctacaattaatacataaccttatgtatcatacacatacgatttaggtgacactatagaacggcgcgccaagctgggtctagaactagaaacgtgatgccacttgttattgaagtcgattacagcatctattctgttttactatttataactttgccatttctgacttttgaaaactatctctggatttcggtatcgctttgtgaagatcgagcaaaagagacgttttgtggacgcaatggtccaaatccgttctacatgaacaaattggtcacaatttccactaaaagtaaataaatggcaagttaaaaaaggaatatgcattttactgattgcctaggtgagctccaagagaagttgaatctacacgtctaccaaccgctaaaaaaagaaaaacattgatatgtaacctgattccattagcttttgacttcttcaacagattctctacttagatttctaacagaaatattattactagcacatcattttcagtctcactacagcaaaaaatccaacggcacaatacagacaacaggagatatcagactacagagatagatagatgctactgcatgtagtaagttaaataaaaggaaaataaaatgtcttgctaccaaaactactacagactatgatgctcaccacaggccaaatcctgcaactaggacagcattatcttatatatattgtacaaaacaagcatcaaggaacatttggtctaggcaatcagtacctcgttctaccatcaccctcagttatcacatccttgaaggatccattactgggaatcatcggcaacacatgctcctgatggggcacaatgacatcaagaaggtaggggccaggggtgtccaacattctctgaattgccgctctaagctcttccttcttcgtcactcgcgctgccggtatcccacaagcatcagcaaacttgagcatgtttgggaatatctcgctctcgctagacggatctccaagataggtgtgagctctattggacttgtagaacctatcctccaactgaaccaccatacccaaatgctgattgttcaacaacaatatcttaactgggagattctccactcttatagtggccaactcctgaacattcatgatgaaactaccatccccatcaatgtcaaccacaacagccccagggttagcaacagcagcaccaatagccgcaggcaatccaaaacccatggctccaagaccccctgaggtcaaccactgcctcggtctcttgtacttgtaaaactgcgcagcccacatttgatgctgcccaaccccagtactaacaatagcatctccattagtcaactcatcaagaacctcgatagcatgctgcggagaaatcgcgtcctggaatgtcttgtaacccaatggaaacttgtgtttctgcacattaatctcttctctccaacctccaagatcaaacttaccctccactcctttctcctccaaaatcatattaattcccttcaaggccaacttcaaatccgcgcaaaccgacacgtgcgcctgcttgttcttcccaatctcggcagaatcaatatcaatgtgaacaatcttagccctactagcaaaagcctcaagcttcccagtaacacggtcatcaaaccttaccccaaaggcaagcaacaaatcactattgtcaacagcatagttagcataaacagtaccatgcatacccagcatctgaagggaatattcatcaccaataggaaaagttccaagacccattaaagtgctagcaacgggaataccagtgagttcaacaaagcgcctcaattcagcactggaattcaaactgccaccgccgacgtagagaacgggcttttgggcctccatgatgagtctgacaatgtgttccaattgggcctcggcggggggcctgggcagcctggcgaggtaaccggggaggttaacgggctcgtcccaattaggcacggcgagttgctgctgaacgtctttgggaatgtcgatgaggaccggaccggggcggccggaggtggcgacgaagaaagcctcggcgacgacgcgggggatgtcgtcgacgtcgaggatgaggtagttgtgcttcgtgatggatctgctcacctccacgatcggggtttcttggaaggcgtcggtgccgatcatccggcgggcgacctggccggtgatggcgacgactgggacgctgtccattaaagcgtcggcgaggccgctcacgaggttggtggcgccggggccggaggtggcaatgcagacgccggggaggccggaggaacgcgcgtagccttcggcggcgaagacgccgccctgctcgtggcgcgggagcacgttgcggatggcggcggagcgcgtgagcgcctggtggatctccatcgacgcaccgccggggtacgcgaacaccgtcgtcacgccctgcctctccagcgcctccacaaggatgtccgcgcccttgcgaggttcgccggaggcgaaccgtgacacgaagggctccgtggtcggcgcttccttggtgaagggcgccgccgtggggggtttggagatggaacatttgattttgagagcgtggttgggtttggtgagggtttgatgagagagagggagggtggatctagtaatgcgtttggggaaggtggggtgtgaagaggaagaagagaatcgggtggttctggaagcggtggccgccattgtgttgtgtggcatggttatacttcaaaaactgcacaacaagcctagagttagtacctaaacagtaaatttacaacagagagcaaagacacatgcaaaaatttcagccataaaaaaagttataatagaatttaaagcaaaagtttcattttttaaacatatatacaaacaaactggatttgaaggaagggattaattcccctgctcaaagtttgaattcctattgtgacctatactcgaataaaattgaagcctaaggaatgtatgagaaacaagaaaacaaaacaaaactacagacaaacaagtacaattacaaaattcgctaaaattctgtaatcaccaaaccccatctcagtcagcacaaggcccaaggtttattttgaaataaaaaaaaagtgattttatttctcataagctaaaagaaagaaaggcaattatgaaatgatttcgactagatctgaaagtccaacgcgtattccgcagatattaaagaaagagtagagtttcacatggatcctagatggacccagttgaggaaaaagcaaggcaaagcaaaccagaagtgcaagatccgaaattgaaccacggaatctaggatttggtagagggagaagaaaagtaccttgagaggtagaagagaagagaagagcagagagatatatgaacgagtgtgtcttggtctcaactctgaagcgatacgagtttagaggggagcattgagttccaatttatagggaaaccgggtggcaggggtgagttaatgacggaaaagcccctaagtaacgagattggattgtgggttagattcaaccgtttgcatccgcggcttagattggggaagtcagagtgaatctcaaccgttgactgagttgaaaattgaatgtagcaaccaattgagccaaccccagcctttgccctttgattttgatttgtttgttgcatactttttatttgtcttctggttctgactctctttctctcgtttcaatgccaggttgcctactcccacaccactcacaagaagattctactgttagtattaaatattttttaatgtattaaatgatgaatgcttttgtaaacagaacaagactatgtctaataagtgtcttgcaacattttttaagaaattaaaaaaaatatatttattatcaaaatcaaatgtatgaaaaatcatgaataatataattttatacatttttttaaaaaatcttttaatttcttaattaatatcttaaaaataatgattaatatttaacccaaaataattagtatgattggtaaggaagatatccatgttatgtttggatgtgagtttgatctagagcaaagcttactagagtcgacctgcaggtcgactcgac

SEQ ID NO: 10 - DNA, 9578 bp, Artificial Sequence
  plasmid BC-Tpom_ALS
gtacgtctagaggatccgtcgacggcgcgcccgatcatccggatatagttcctcctttcagcaaaaaacccctcaagacccgtttagaggccccaaggggttatgctagttattgctcagcggtggcagcagccaactcagcttcctttcgggctttgttagcagccggatcgatccaagctgtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggcttttccatgggtatatctccttcttaaagttaaacaaaattatttctagagggaaaccgttgtggtctccctatagtgagtcgtattaatttcgcgggatcgagatctgatcaacctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatggacatattgtcgttagaacgcggctacaattaatacataaccttatgtatcatacacatacgatttaggtgacactatagaacggcgcgccaagctgggtctagaactagaaacgtgatgccacttgttattgaagtcgattacagcatctattctgttttactatttataactttgccatttctgacttttgaaaactatctctggatttcggtatcgctttgtgaagatcgagcaaaagagacgttttgtggacgcaatggtccaaatccgttctacatgaacaaattggtcacaatttccactaaaagtaaataaatggcaagttaaaaaaggaatatgcattttactgattgcctaggtgagctccaagagaagttgaatctacacgtctaccaaccgctaaaaaaagaaaaacattgatatgtaacctgattccattagcttttgacttcttcaacagattctctacttagatttctaacagaaatattattactagcacatcattttcagtctcactacagcaaaaaatccaacggcacaatacagacaacaggagatatcagactacagagatagatagatgctactgcatgtagtaagttaaataaaaggaaaataaaatgtcttgctaccaaaactactacagactatgatgctcaccacaggccaaatcctgcaactaggacagcattatcttatatatattgtacaaaacaagcatcaaggaacatttggtctaggcaatcagtacctcgttctaccatcaccctcagttatcacatccttgaaggatccattactgggaatcatcggcaacacatgctcctgatggggcacaatgacatcaagaaggtaggggccaggggtgtccaacattctctgaattgccgctctaagctcttccttcttcgtcactcgcgctgccggtatcccacaagcatcagcaaacttgagcatgtttgggaatatctcgctctcgctagacggatctccaagataggtgtgagctctattggacttgtagaacctatcctccaactgaaccaccatacccaaatgctgattgttcaacaacaatatcttaactgggagattctccactcttatagtggccaactcctgaacattcatgatgaaactaccatccccatcaatgtcaaccacaacagccccagggttagcaacagcagcaccaatagccgcaggcaatccaaaacccatggctccaagaccccctgaggtcaaccactgcctcggtctcttgtacttgtaaaactgcgcagcccacatttgatgctgcccaaccccagtactaacaatagcatctccattagtcaactcatcaagaacctcgatagcatgctgcggagaaatcgcgtcctggaatgtcttgtaacccaatggaaacttgtgtttctgcacattaatctcttctctccaacctccaagatcaaacttaccctccactcctttctcctccaaaatcatattaattcccttcaaggccaacttcaaatccgcgcaaaccgacacgtgcgcctgcttgttcttcccaatctcggcagaatcaatatcaatgtgaacaatcttagccctactagcaaaagcctcaagcttcccagtaacacggtcatcaaaccttaccccaaaggcaagcaacaaatcactattgtcaacagcatagttagcataaacagtaccatgcatacccagcatctgaagggaatattcatcaccaataggaaaagttccaagacccattaaagtgctagcaacgggaataccagtgagttcaacaaagcgcctcaattcagcactggaattcaaactgccaccgccgacgtagagaacgggcttttgggcctccatgatgagtctgacaatgtgttccaattgggcctcggcggggggcctgggcagcctggcgaggtaaccggggaggttaacgggctcgtcccaattaggcacggcgagttgctgctgaacgtctttgggaatgtcgatgaggaccggaccggggcggccggaggtggcgacgaagaaagcctcggcgacgacgcgggggatgtcgtcgacgtcgaggatgaggtagttgtgcttcgtgatggatctgctcacctccacgatcggggtttcttggaaggcgtcggtgccgatcatccggcgggcgacctggccggtgatggcgacgactgggacgctgtccattaaagcgtcggcgaggccgctcacgaggttggtggcgccggggccggaggtggcaatgcagacgccggggaggccggaggaacgcgcgtagccttcggcggcgaagacgccgccctgctcgtggcgcgggagcacgttgcggatggcggcggagcgcgtgagcgcctggtggatctccatcgacgcaccgccggggtacgcgaacaccgtcgtcacgccctgcctctccagcgcctccacaaggatgtccgcgcccttgcgaggttcgccggaggcgaaccgtgacacgaagggctccgtggtcggcgcttccttggtgaagggcgccgccgtggggggtttggagatggaacatttgattttgagagcgtggttgggtttggtgagggtttgatgagagagagggagggtggatctagtaatgcgtttggggaaggtggggtgtgaagaggaagaagagaatcgggtggttctggaagcggtggccgccattgtgttgtgtggcatggttatacttcaaaaactgcacaacaagcctagagttagtacctaaacagtaaatttacaacagagagcaaagacacatgcaaaaatttcagccataaaaaaagttataatagaatttaaagcaaaagtttcattttttaaacatatatacaaacaaactggatttgaaggaagggattaattcccctgctcaaagtttgaattcctattgtgacctatactcgaataaaattgaagcctaaggaatgtatgagaaacaagaaaacaaaacaaaactacagacaaacaagtacaattacaaaattcgctaaaattctgtaatcaccaaaccccatctcagtcagcacaaggcccaaggtttattttgaaataaaaaaaaagtgattttatttctcataagctaaaagaaagaaaggcaattatgaaatgatttcgactagatctgaaagtccaacgcgtattccgcagatattaaagaaagagtagagtttcacatggatcctagatggacccagttgaggaaaaagcaaggcaaagcaaaccagaagtgcaagatccgaaattgaaccacggaatctaggatttggtagagggagaagaaaagtaccttgagaggtagaagagaagagaagagcagagagatatatgaacgagtgtgtcttggtctcaactctgaagcgatacgagtttagaggggagcattgagttccaatttatagggaaaccgggtggcaggggtgagttaatgacggaaaagcccctaagtaacgagattggattgtgggttagattcaaccgtttgcatccgcggcttagattggggaagtcagagtgaatctcaaccgttgactgagttgaaaattgaatgtagcaaccaattgagccaaccccagcctttgccctttgattttgatttgtttgttgcatactttttatttgtcttctggttctgactctctttctctcgtttcaatgccaggttgcctactcccacaccactcacaagaagattctactgttagtattaaatattttttaatgtattaaatgatgaatgcttttgtaaacagaacaagactatgtctaataagtgtcttgcaacattttttaagaaattaaaaaaaatatatttattatcaaaatcaaatgtatgaaaaatcatgaataatataattttatacatttttttaaaaaatcttttaatttcttaattaatatcttaaaaataatgattaatatttaacccaaaataattagtatgattggtaaggaagatatccatgttatgtttggatgtgagtttgatctagagcaaagcttactagagtcgacctgcaggatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcaccatgtctcctaagcggcaagctctgccaatcacaattgatggcgcaacttatgatgtgtctgcttgggtcaatcaccaccctggaggagctgacattatcgagaactatcgcaaccgcgatgcgaccgatgtcttcatggtgatgcactctcaagaagccgtcgccaagttgaagagaatgcctgttatggagccttcctctcctgacacacctgttgcacccaagcctaagcgtgatgagccccaggaggatttccgcaagttgcgggaggaattcatctccaagggtatgttcgagacgagtttcctttggtatttttacaagacttcaactaccgtcggtttgatggtcctttccatcttgatgaccgtgtacacgaattggtatttcaccgctgctttggttcttggcgtgtgctaccaacagctaggctggttgtcccacgactattgccatcaccaggttttcacaaaccgcaagattaacgacgctttcggtctctttttcggtaacgtgatgcagggatactcacagacttggtggaaggataggcacaatggtcaccatgccgccaccaatgtggtcggccatgacccagatattgataacctccccatcctggcttggtctcccgaagatgtcaagagggctactccttcgactcggaatctcatcaagtaccagcagtactacttcattcccaccattgcatcccttaggttcatctggtgcctccaatccatcggcggcgtcatgtcctacaagagcgaggagaggaacctgtactacaagcgccagtacactaaggaggcgattggtctggccctccactgggtgctcaaggccactttctattgcagtgccatgcctagctttgccaccggtttgggatgcttcttgatctccgagctgctcggaggatttggcattgccatcgttgtgtttctgaatcactatcctttggacaaggttgaggagactgtctgggatgagcacgggttcagcgccagccagatccacgagacgttgaacattaagcccggccttctcaccgattgggtctttggtggtctcaactaccagattgagcaccacttgtggcccaacatgcccaggcacaacctcacggcagcttccctggaggtgcagaagttgtgcgccaagcacaacctgccctacagggccccagccatcatccccggggttcagaaattggtcagcttcttaggcgagattgcccagctggctgctgtccctgaatgagcggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacctgcaggtcgactcgac

SEQ ID NO: 11 - DNA, 9578 bp, Artificial Sequence
  plasmid BC-Tpom_ALSrev
gtacgtctagaggatccgtcgacggcgcgcccgatcatccggatatagttcctcctttcagcaaaaaacccctcaagacccgtttagaggccccaaggggttatgctagttattgctcagcggtggcagcagccaactcagcttcctttcgggctttgttagcagccggatcgatccaagctgtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggcttttccatgggtatatctccttcttaaagttaaacaaaattatttctagagggaaaccgttgtggtctccctatagtgagtcgtattaatttcgcgggatcgagatctgatcaacctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatggacatattgtcgttagaacgcggctacaattaatacataaccttatgtatcatacacatacgatttaggtgacactatagaacggcgcgccaagctgggtctagaactagaaacgtgatgccacttgttattgaagtcgattacagcatctattctgttttactatttataactttgccatttctgacttttgaaaactatctctggatttcggtatcgctttgtgaagatcgagcaaaagagacgttttgtggacgcaatggtccaaatccgttctacatgaacaaattggtcacaatttccactaaaagtaaataaatggcaagttaaaaaaggaatatgcattttactgattgcctaggtgagctccaagagaagttgaatctacacgtctaccaaccgctaaaaaaagaaaaacattgatatgtaacctgattccattagcttttgacttcttcaacagattctctacttagatttctaacagaaatattattactagcacatcattttcagtctcactacagcaaaaaatccaacggcacaatacagacaacaggagatatcagactacagagatagatagatgctactgcatgtagtaagttaaataaaaggaaaataaaatgtcttgctaccaaaactactacagactatgatgctcaccacaggccaaatcctgcaactaggacagcattatcttatatatattgtacaaaacaagcatcaaggaacatttggtctaggcaatcagtacctcgttctaccatcaccctcagttatcacatccttgaaggatccattactgggaatcatcggcaacacatgctcctgatggggcacaatgacatcaagaaggtaggggccaggggtgtccaacattctctgaattgccgctctaagctcttccttcttcgtcactcgcgctgccggtatcccacaagcatcagcaaacttgagcatgtttgggaatatctcgctctcgctagacggatctccaagataggtgtgagctctattggacttgtagaacctatcctccaactgaaccaccatacccaaatgctgattgttcaacaacaatatcttaactgggagattctccactcttatagtggccaactcctgaacattcatgatgaaactaccatccccatcaatgtcaaccacaacagccccagggttagcaacagcagcaccaatagccgcaggcaatccaaaacccatggctccaagaccccctgaggtcaaccactgcctcggtctcttgtacttgtaaaactgcgcagcccacatttgatgctgcccaaccccagtactaacaatagcatctccattagtcaactcatcaagaacctcgatagcatgctgcggagaaatcgcgtcctggaatgtcttgtaacccaatggaaacttgtgtttctgcacattaatctcttctctccaacctccaagatcaaacttaccctccactcctttctcctccaaaatcatattaattcccttcaaggccaacttcaaatccgcgcaaaccgacacgtgcgcctgcttgttcttcccaatctcggcagaatcaatatcaatgtgaacaatcttagccctactagcaaaagcctcaagcttcccagtaacacggtcatcaaaccttaccccaaaggcaagcaacaaatcactattgtcaacagcatagttagcataaacagtaccatgcatacccagcatctgaagggaatattcatcaccaataggaaaagttccaagacccattaaagtgctagcaacgggaataccagtgagttcaacaaagcgcctcaattcagcactggaattcaaactgccaccgccgacgtagagaacgggcttttgggcctccatgatgagtctgacaatgtgttccaattgggcctcggcggggggcctgggcagcctggcgaggtaaccggggaggttaacgggctcgtcccaattaggcacggcgagttgctgctgaacgtctttgggaatgtcgatgaggaccggaccggggcggccggaggtggcgacgaagaaagcctcggcgacgacgcgggggatgtcgtcgacgtcgaggatgaggtagttgtgcttcgtgatggatctgctcacctccacgatcggggtttcttggaaggcgtcggtgccgatcatccggcgggcgacctggccggtgatggcgacgactgggacgctgtccattaaagcgtcggcgaggccgctcacgaggttggtggcgccggggccggaggtggcaatgcagacgccggggaggccggaggaacgcgcgtagccttcggcggcgaagacgccgccctgctcgtggcgcgggagcacgttgcggatggcggcggagcgcgtgagcgcctggtggatctccatcgacgcaccgccggggtacgcgaacaccgtcgtcacgccctgcctctccagcgcctccacaaggatgtccgcgcccttgcgaggttcgccggaggcgaaccgtgacacgaagggctccgtggtcggcgcttccttggtgaagggcgccgccgtggggggtttggagatggaacatttgattttgagagcgtggttgggtttggtgagggtttgatgagagagagggagggtggatctagtaatgcgtttggggaaggtggggtgtgaagaggaagaagagaatcgggtggttctggaagcggtggccgccattgtgttgtgtggcatggttatacttcaaaaactgcacaacaagcctagagttagtacctaaacagtaaatttacaacagagagcaaagacacatgcaaaaatttcagccataaaaaaagttataatagaatttaaagcaaaagtttcattttttaaacatatatacaaacaaactggatttgaaggaagggattaattcccctgctcaaagtttgaattcctattgtgacctatactcgaataaaattgaagcctaaggaatgtatgagaaacaagaaaacaaaacaaaactacagacaaacaagtacaattacaaaattcgctaaaattctgtaatcaccaaaccccatctcagtcagcacaaggcccaaggtttattttgaaataaaaaaaaagtgattttatttctcataagctaaaagaaagaaaggcaattatgaaatgatttcgactagatctgaaagtccaacgcgtattccgcagatattaaagaaagagtagagtttcacatggatcctagatggacccagttgaggaaaaagcaaggcaaagcaaaccagaagtgcaagatccgaaattgaaccacggaatctaggatttggtagagggagaagaaaagtaccttgagaggtagaagagaagagaagagcagagagatatatgaacgagtgtgtcttggtctcaactctgaagcgatacgagtttagaggggagcattgagttccaatttatagggaaaccgggtggcaggggtgagttaatgacggaaaagcccctaagtaacgagattggattgtgggttagattcaaccgtttgcatccgcggcttagattggggaagtcagagtgaatctcaaccgttgactgagttgaaaattgaatgtagcaaccaattgagccaaccccagcctttgccctttgattttgatttgtttgttgcatactttttatttgtcttctggttctgactctctttctctcgtttcaatgccaggttgcctactcccacaccactcacaagaagattctactgttagtattaaatattttttaatgtattaaatgatgaatgcttttgtaaacagaacaagactatgtctaataagtgtcttgcaacattttttaagaaattaaaaaaaatatatttattatcaaaatcaaatgtatgaaaaatcatgaataatataattttatacatttttttaaaaaatcttttaatttcttaattaatatcttaaaaataatgattaatatttaacccaaaataattagtatgattggtaaggaagatatccatgttatgtttggatgtgagtttgatctagagcaaagcttactagagtcgacctgcaggttgaaacatccctgaagtgtctcattttattttatttattctttgctgataaaaaaataaaataaaagaagctaagcacacggtcaaccattgctctactgctaaaagggttatgtgtagtgttttactgcataaattatgcagcaaacaagacaactcaaattaaaaaatttcctttgcttgtttttttgttgtctctgacttgactttcttgtggaagttggttgtataaggattgggacaccattgtccttcttaatttaattttattctttgctgataaaaaaaaaaatttcatatagtgttaaataataatttgttaaataaccaaaaagtcaaatatgtttactctcgtttaaataattgagattcgtccagcaaggctaaacgattgtatagatttatgacaatatttacttttttatagataaatgttatattataataaatttatatacatatattatatgttatttattattattttaaatccttcaatattttatcaaaccaactcataattttttttttatctgtaagaagcaataaaattaaatagacccactttaaggatgatccaacctttatacagagtaagagagttcaaatagtaccctttcatatacatatcaactaaaatattagaaatatcatggatcaaaccttataaagacattaaataagtggataagtataatatataaatgggtagtatataatatataaatggatacaaacttctctctttataattgttatgtctccttaacatcctaatataatacataagtgggtaatatataatatataaatggagacaaacttcttccattataattgttatgtcttcttaacacttatgtctcgttcacaatgctaaggttagaattgtttagaaagtcttatagtacacatttgtttttgtactatttgaagcattccataagccgtcacgattcagatgatttataataataagaggaaatttatcatagaacaataaggtgcatagatagagtgttaatatatcataacatcctttgtttattcatagaagaagtgagatggagctcagttattatactgttacatggtcggatacaatattccatgctctccatgagctcttacacctacatgcattttagttcatacttgcggccgctcattcagggacagcagccagctgggcaatctcgcctaagaagctgaccaatttctgaaccccggggatgatggctggggccctgtagggcaggttgtgcttggcgcacaacttctgcacctccagggaagctgccgtgaggttgtgcctgggcatgttgggccacaagtggtgctcaatctggtagttgagaccaccaaagacccaatcggtgagaaggccgggcttaatgttcaacgtctcgtggatctggctggcgctgaacccgtgctcatcccagacagtctcctcaaccttgtccaaaggatagtgattcagaaacacaacgatggcaatgccaaatcctccgagcagctcggagatcaagaagcatcccaaaccggtggcaaagctaggcatggcactgcaatagaaagtggccttgagcacccagtggagggccagaccaatcgcctccttagtgtactggcgcttgtagtacaggttcctctcctcgctcttgtaggacatgacgccgccgatggattggaggcaccagatgaacctaagggatgcaatggtgggaatgaagtagtactgctggtacttgatgagattccgagtcgaaggagtagccctcttgacatcttcgggagaccaagccaggatggggaggttatcaatatctgggtcatggccgaccacattggtggcggcatggtgaccattgtgcctatccttccaccaagtctgtgagtatccctgcatcacgttaccgaaaaagagaccgaaagcgtcgttaatcttgcggtttgtgaaaacctggtgatggcaatagtcgtgggacaaccagcctagctgttggtagcacacgccaagaaccaaagcagcggtgaaataccaattcgtgtacacggtcatcaagatggaaaggaccatcaaaccgacggtagttgaagtcttgtaaaaataccaaaggaaactcgtctcgaacatacccttggagatgaattcctcccgcaacttgcggaaatcctcctggggctcatcacgcttaggcttgggtgcaacaggtgtgtcaggagaggaaggctccataacaggcattctcttcaacttggcgacggcttcttgagagtgcatcaccatgaagacatcggtcgcatcgcggttgcgatagttctcgataatgtcagctcctccagggtggtgattgacccaagcagacacatcataagttgcgccatcaattgtgattggcagagcttgccgcttaggagacatggtgcggccgcagtatatcttaaattctttaatacggtgtactaggatattgaactggttcttgatgatgaaaacctgggccgagattgcagctatttatagtcataggtcttgttaacatgcatggacatttggccacggggtggcatgcagtttgacgggtgttgaaataaacaaaaatgaggtggcggaagagaatacgagtttgaggttgggttagaaacaacaaatgtgagggctcatgatgggttgagttggtgaatgttttgggctgctcgattgacacctttgtgagtacgtgttgttgtgcatggcttttggggtccagtttttttttcttgacgcggcgatcctgatcagctagtggataagtgatgtccactgtgtgtgattgcgtttttgtttgaattttatgaacttagacattgctatgcaaaggatactctcattgtgttttgtcttcttttgttccttggctttttcttatgatccaagagactagtcagtgttgtggcattcgagactaccaagattaattatgatgggggaaggataagtaactgattagtacggactgttaccaaattaattaataagcggcaaatgaagggcatggatcctgcaggtcgactcgac

SEQ ID NO: 12 - DNA, 3983 bp, Artificial Sequence
  plasmid pKR132
ctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcgagctcggtacccggggatcctctagacctgcaggccaactgcgtttggggctccagattaaacgacgccgtttcgttcctttcgcttcacggcttaacgatgtcgtttctgtctgtgcccaaaaaataaaggcatttgttatttgcaccagatatttactaagtgcaccctagtttgacaagtaggcgataattacaaatagatgcggtgcaaataataaattttgaaggaaataattacaaaagaacagaacttatatttactttattttaaaaaactaaaatgaaagaacaaaaaaagtaaaaaatacaaaaaatgtgctttaaccactttcattatttgttacagaaagtatgattctactcaaattgatctgttgtatctggtgctgccttgtcacactggcgatttcaatcccctaaagatatggtgcaaactgcgaagtgatcaatatctgctcggttaatttagattaattaataatattcaacgtgatgtaccaaaaaaagacaattttttgctccattgacaaattaaacctcatcaaggtaatttccaaacctataagcaaaaaaatttcacattaattggcccgcaatcctattagtcttattatactagagtaggaaaaaaaacaattacacaacttgtcttattattctctatgctaatgaatatttttcccttttgttagaaatcagtgtttcctaatttattgagtattaattccactcaccgcatatatttaccgttgaataagaaaattttacacataattctttttaagataaataatttttttatactagatcttatatgattacgtgaagccaagtgggttatactaatgatatataatgtttgatagtaatcagtttataaaccaaatgcatggaaatgttacgtggaagcacgtaaattaacaagcattgaagcaaatgcagccaccgcaccaaaaccaccccacttcacttccacgtaccatattccatgcaactacaacaccctaaaacttcaataaatgcccccaccttcacttcacttcacccatcaatagcaagcggccgcgaagttaaaagcaatgttgtcacttgtcgtactaacacatgatgtgatagtttatgctagctagctataacataagctgtctctgagtgtgttgtatattaataaagatcatcactggtgaatggtgatcgtgtacgtaccctacttagtaggcaatggaagcacttagagtgtgctttgtgcatggccttgcctctgttttgagacttttgtaatgttttcgagtttaaatctttgcctttgcgtacgt

SEQ ID NO: 13 - DNA, 29 bp, Artificial Sequence
  primer EgD5-5Not
gcggccgcaccatggctctcagtcttacc

SEQ ID NO: 14 - DNA, 27 bp, Artificial Sequence
  primer EgD5-3Not
gcggccgctcaggaatcctgtgcgtcc

SEQ ID NO: 15 - DNA, 4906 bp, Artificial Sequence
  plasmid pKR268
ggccgcatgagccgtaaaggttcaatacaacgagtgcttgttttcttagggacaagcattgtacttatgtatgattctgtgtaaccatgagtcttccacgttgtactaatgtgaagggcaaaaataaaacacagaacaagttcgtttttctcaaataatgtgaaggtagaaaatggaaccatgcctcctctcttgcatgtgatttaaaatattagcagatggtaccgtacgtgggcggatcccccgggctgcaggaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttgcatgcctgcaggtcgactcgacgtacgatcccacatgcaagtttttatttcaatcccttttcctttgaataactgaccaagaacaacaagaaaaaaaaaaaaaaagaaaaggatcattttgaaaggatatttttcgctcctattcaaatactgtatttttaccaaaaaaactgtatttttcctacactctcaagctttgtttttcgcttcgactctcatgatttccttcatatgccaatcactctatttataaatggcataaggtagtgtgaacaattgcaaagcttgtcatcaaaagcttgcaatgtacaaattaatgtttttcatgcctttcaaaattatctgcaccccctagctattaatctaacatctaagtaaggctagtgaattttttcgaatagtcatgcagtgcattaatttccccgtgactattttggctttgactccaacactggccccgtacatccgtccctcattacatgaaaagaaatattgtttatattcttaattaaaaatattgtcccttctaaattttcatatagttaattattatattacttttttctctattctattagttctattttcaaattattatttatgcatatgtaaagtacattatatttttgctatatacttaaatatttctaaattattaaaaaaagactgatatgaaaaatttattctttttaaagctatatcattttatatatactttttcttttcttttctttcattttctattcaatttaataagaaataaattttgtaaatttttatttatcaatttataaaaatattttactttatatgttttttcacatttttgttaaacaaatcatatcattatgattgaaagagaggaaattgacagtgagtaataagtgatgagaaaaaaatgtgttatttcctaaaaaaaacctaaacaaacatgtatctactctctatttcatctatctctcatttcatttttctctttatctctttctttatttttttatcatatcatttcacattaattatttttactctctttattttttctctctatccctctcttatttccactcatatatacactccaaaattggggcatgcctttatcactactctatctcctccactaaatcatttaaatgaaactgaaaagcattggcaagtctcctcccctcctcaagtgatttccaactcagcattggcatctaattgattcagtatatctattgcatgtgtaaaagtctttccacaatacataactattaattaatcttaaataaataaaggataaaatatttttttttcttcataaaattaaaatatgttattttttgtttagatgtatattcgaataaatctaaatatatgataatgattttttatattgattaaacatataatcaatattaaatatgatatttttttatataggttgtacacataattttataaggataaaaaatatgataaaaataaattttaaatatttttatatttacgagaaaaaaaaatattttagccataaataaatgaccagcatattttacaaccttagtaattcataaattcctatatgtatatttgaaattaaaaacagataatcgttaagggaaggaatcctacgtcatctcttgccatttgtttttcatgcaaacagaaagggacgaaaaaccacctcaccatgaatcactcttcacaccatttttactagcaaacaagtctcaacaactgaagccagctctctttccgtttctttttacaacactttctttgaaatagtagtatttttttttcacatgatttattaacgtgccaaaagatgcttattgaatagagtgcacatttgtaatgtactactaattagaacatgaaaaagcattgttctaacacgataatcctgtgaaggcgttaactccaaagatccaatttcactatataaattgtgacgaaagcaaaatgaattcacatagctgagagagaaaggaaaggttaactaagaagcaatacttcagc

SEQ ID NO: 16 - DNA, 6267 bp, Artificial Sequence
  plasmid Ann-EgD5
ggccgcatgagccgtaaaggttcaatacaacgagtgcttgttttcttagggacaagcattgtacttatgtatgattctgtgtaaccatgagtcttccacgttgtactaatgtgaagggcaaaaataaaacacagaacaagttcgtttttctcaaataatgtgaaggtagaaaatggaaccatgcctcctctcttgcatgtgatttaaaatattagcagatggtaccgtacgtgggcggatcccccgggctgcaggaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttgcatgcctgcaggtcgactcgacgtacgatcccacatgcaagtttttatttcaatcccttttcctttgaataactgaccaagaacaacaagaaaaaaaaaaaaaaagaaaaggatcattttgaaaggatatttttcgctcctattcaaatactgtatttttaccaaaaaaactgtatttttcctacactctcaagctttgtttttcgcttcgactctcatgatttccttcatatgccaatcactctatttataaatggcataaggtagtgtgaacaattgcaaagcttgtcatcaaaagcttgcaatgtacaaattaatgtttttcatgcctttcaaaattatctgcaccccctagctattaatctaacatctaagtaaggctagtgaattttttcgaatagtcatgcagtgcattaatttccccgtgactattttggctttgactccaacactggccccgtacatccgtccctcattacatgaaaagaaatattgtttatattcttaattaaaaatattgtcccttctaaattttcatatagttaattattatattacttttttctctattctattagttctattttcaaattattatttatgcatatgtaaagtacattatatttttgctatatacttaaatatttctaaattattaaaaaaagactgatatgaaaaatttattctttttaaagctatatcattttatatatactttttcttttcttttctttcattttctattcaatttaataagaaataaattttgtaaatttttatttatcaatttataaaaatattttactttatatgttttttcacatttttgttaaacaaatcatatcattatgattgaaagagaggaaattgacagtgagtaataagtgatgagaaaaaaatgtgttatttcctaaaaaaaacctaaacaaacatgtatctactctctatttcatctatctctcatttcatttttctctttatctctttctttatttttttatcatatcatttcacattaattatttttactctctttattttttctctctatccctctcttatttccactcatatatacactccaaaattggggcatgcctttatcactactctatctcctccactaaatcatttaaatgaaactgaaaagcattggcaagtctcctcccctcctcaagtgatttccaactcagcattggcatctaattgattcagtatatctattgcatgtgtaaaagtctttccacaatacataactattaattaatcttaaataaataaaggataaaatatttttttttcttcataaaattaaaatatgttattttttgtttagatgtatattcgaataaatctaaatatatgataatgattttttatattgattaaacatataatcaatattaaatatgatatttttttatataggttgtacacataattttataaggataaaaaatatgataaaaataaattttaaatatttttatatttacgagaaaaaaaaatattttagccataaataaatgaccagcatattttacaaccttagtaattcataaattcctatatgtatatttgaaattaaaaacagataatcgttaagggaaggaatcctacgtcatctcttgccatttgtttttcatgcaaacagaaagggacgaaaaaccacctcaccatgaatcactcttcacaccatttttactagcaaacaagtctcaacaactgaagccagctctctttccgtttctttttacaacactttctttgaaatagtagtatttttttttcacatgatttattaacgtgccaaaagatgcttattgaatagagtgcacatttgtaatgtactactaattagaacatgaaaaagcattgttctaacacgataatcctgtgaaggcgttaactccaaagatccaatttcactatataaattgtgacgaaagcaaaatgaattcacatagctgagagagaaaggaaaggttaactaagaagcaatacttcagcggccgcaccatggctctcagtcttaccacagaacagctgttagaacgccctgatttggttgcgattgatggcatcctctacgaccttgaagggcttgccaaagttcatccaggaggagatttgattctcgcttctggtgcctctgatgcctcccctctcttttattcgatgcatccatacgtcaaaccggagaattccaaattgcttcaacagttcgtccgagggaagcatgaccgcacctcgaaggacattgtctacacgtatgattctcccttcgcacaagacgttaagcggacaatgcgcgaggtgatgaaagggaggaactggtacgcaacccctggcttctggctgcgcaccgttgggatcatcgccgtgacggccttttgcgagtggcactgggctaccacggggatggtgctgtggggcctgctgactggattcatgcacatgcagatcggcttatccatccagcatgatgcgtcccacggggccatcagcaagaagccttgggtcaacgccctcttcgcctacggcattgacgtcatcggatcgtcccggtggatttggctgcagtcgcacatcatgcggcaccacacctacaccaaccagcacggcctcgacctggatgcggagtcggcagagccgttcctggtgttccacaactaccccgccgcaaacaccgcccgaaagtggttccaccgcttccaagcttggtacatgtaccttgtgctgggggcatacggggtatcgctggtgtacaacccgctctacattttccggatgcagcacaatgacaccatcccagagtctgtcacggccatgcgggagaatggctttctgcggcgctaccgcacacttgcattcgtgatgcgagctttcttcatcttccggaccgcattcttgccctggtacctcactgggacctcattgctgatcaccattcctctggtgcccactgcaactggtgccttcttgacgttcttcttcattttgtcccacaattttgatggctccgaacggatccccgacaagaactgcaaggttaagagctctgagaaggacgttgaggctgaccaaattgactggtatcgggcgcaggtggagacgtcctccacatacggtggccccatcgccatgttcttcactggcggtctcaatttccagatcgagcaccacctctttccccggatgtcgtcttggcactaccccttcgtccagcaggcggtccgggagtgttgcgaacgccatggagtgcgatatgttttctatcctaccatcgtcggcaacatcatctccaccctgaagtacatgcataaggtgggtgtcgtccactgcgtgaaggacgcacaggattcctgagc

SEQ ID NO: 17 - DNA, 13153 bp, Artificial Sequence
  plasmid BC-Tpom_Ann-EgD5_ALS
gtacgtctagaggatccgtcgacggcgcgcccgatcatccggatatagttcctcctttcagcaaaaaacccctcaagacccgtttagaggccccaaggggttatgctagttattgctcagcggtggcagcagccaactcagcttcctttcgggctttgttagcagccggatcgatccaagctgtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggcttttccatgggtatatctccttcttaaagttaaacaaaattatttctagagggaaaccgttgtggtctccctatagtgagtcgtattaatttcgcgggatcgagatctgatcaacctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatggacatattgtcgttagaacgcggctacaattaatacataaccttatgtatcatacacatacgatttaggtgacactatagaacggcgcgccaagctgggtctagaactagaaacgtgatgccacttgttattgaagtcgattacagcatctattctgttttactatttataactttgccatttctgacttttgaaaactatctctggatttcggtatcgctttgtgaagatcgagcaaaagagacgttttgtggacgcaatggtccaaatccgttctacatgaacaaattggtcacaatttccactaaaagtaaataaatggcaagttaaaaaaggaatatgcattttactgattgcctaggtgagctccaagagaagttgaatctacacgtctaccaaccgctaaaaaaagaaaaacattgatatgtaacctgattccattagcttttgacttcttcaacagattctctacttagatttctaacagaaatattattactagcacatcattttcagtctcactacagcaaaaaatccaacggcacaatacagacaacaggagatatcagactacagagatagatagatgctactgcatgtagtaagttaaataaaaggaaaataaaatgtcttgctaccaaaactactacagactatgatgctcaccacaggccaaatcctgcaactaggacagcattatcttatatatattgtacaaaacaagcatcaaggaacatttggtctaggcaatcagtacctcgttctaccatcaccctcagttatcacatccttgaaggatccattactgggaatcatcggcaacacatgctcctgatggggcacaatgacatcaagaaggtaggggccaggggtgtccaacattctctgaattgccgctctaagctcttccttcttcgtcactcgcgctgccggtatcccacaagcatcagcaaacttgagcatgtttgggaatatctcgctctcgctagacggatctccaagataggtgtgagctctattggacttgtagaacctatcctccaactgaaccaccatacccaaatgctgattgttcaacaacaatatcttaactgggagattctccactcttatagtggccaactcctgaacattcatgatgaaactaccatccccatcaatgtcaaccacaacagccccagggttagcaacagcagcaccaatagccgcaggcaatccaaaacccatggctccaagaccccctgaggtcaaccactgcctcggtctcttgtacttgtaaaactgcgcagcccacatttgatgctgcccaaccccagtactaacaatagcatctccattagtcaactcatcaagaacctcgatagcatgctgcggagaaatcgcgtcctggaatgtcttgtaacccaatggaaacttgtgtttctgcacattaatctcttctctccaacctccaagatcaaacttaccctccactcctttctcctccaaaatcatattaattcccttcaaggccaacttcaaatccgcgcaaaccgacacgtgcgcctgcttgttcttcccaatctcggcagaatcaatatcaatgtgaacaatcttagccctactagcaaaagcctcaagcttcccagtaacacggtcatcaaaccttaccccaaaggcaagcaacaaatcactattgtcaacagcatagttagcataaacagtaccatgcatacccagcatctgaagggaatattcatcaccaataggaaaagttccaagacccattaaagtgctagcaacgggaataccagtgagttcaacaaagcgcctcaattcagcactggaattcaaactgccaccgccgacgtagagaacgggcttttgggcctccatgatgagtctgacaatgtgttccaattgggcctcggcggggggcctgggcagcctggcgaggtaaccggggaggttaacgggctcgtcccaattaggcacggcgagttgctgctgaacgtctttgggaatgtcgatgaggaccggaccggggcggccggaggtggcgacgaagaaagcctcggcgacgacgcgggggatgtcgtcgacgtcgaggatgaggtagttgtgcttcgtgatggatctgctcacctccacgatcggggtttcttggaaggcgtcggtgccgatcatccggcgggcgacctggccggtgatggcgacgactgggacgctgtccattaaagcgtcggcgaggccgctcacgaggttggtggcgccggggccggaggtggcaatgcagacgccggggaggccggaggaacgcgcgtagccttcggcggcgaagacgccgccctgctcgtggcgcgggagcacgttgcggatggcggcggagcgcgtgagcgcctggtggatctccatcgacgcaccgccggggtacgcgaacaccgtcgtcacgccctgcctctccagcgcctccacaaggatgtccgcgcccttgcgaggttcgccggaggcgaaccgtgacacgaagggctccgtggtcggcgcttccttggtgaagggcgccgccgtggggggtttggagatggaacatttgattttgagagcgtggttgggtttggtgagggtttgatgagagagagggagggtggatctagtaatgcgtttggggaaggtggggtgtgaagaggaagaagagaatcgggtggttctggaagcggtggccgccattgtgttgtgtggcatggttatacttcaaaaactgcacaacaagcctagagttagtacctaaacagtaaatttacaacagagagcaaagacacatgcaaaaatttcagccataaaaaaagttataatagaatttaaagcaaaagtttcattttttaaacatatatacaaacaaactggatttgaaggaagggattaattcccctgctcaaagtttgaattcctattgtgacctatactcgaataaaattgaagcctaaggaatgtatgagaaacaagaaaacaaaacaaaactacagacaaacaagtacaattacaaaattcgctaaaattctgtaatcaccaaaccccatctcagtcagcacaaggcccaaggtttattttgaaataaaaaaaaagtgattttatttctcataagctaaaagaaagaaaggcaattatgaaatgatttcgactagatctgaaagtccaacgcgtattccgcagatattaaagaaagagtagagtttcacatggatcctagatggacccagttgaggaaaaagcaaggcaaagcaaaccagaagtgcaagatccgaaattgaaccacggaatctaggatttggtagagggagaagaaaagtaccttgagaggtagaagagaagagaagagcagagagatatatgaacgagtgtgtcttggtctcaactctgaagcgatacgagtttagaggggagcattgagttccaatttatagggaaaccgggtggcaggggtgagttaatgacggaaaagcccctaagtaacgagattggattgtgggttagattcaaccgtttgcatccgcggcttagattggggaagtcagagtgaatctcaaccgttgactgagttgaaaattgaatgtagcaaccaattgagccaaccccagcctttgccctttgattttgatttgtttgttgcatactttttatttgtcttctggttctgactctctttctctcgtttcaatgccaggttgcctactcccacaccactcacaagaagattctactgttagtattaaatattttttaatgtattaaatgatgaatgcttttgtaaacagaacaagactatgtctaataagtgtcttgcaacattttttaagaaattaaaaaaaatatatttattatcaaaatcaaatgtatgaaaaatcatgaataatataattttatacatttttttaaaaaatcttttaatttcttaattaatatcttaaaaataatgattaatatttaacccaaaataattagtatgattggtaaggaagatatccatgttatgtttggatgtgagtttgatctagagcaaagcttactagagtcgacctgcaggatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcaccatgtctcctaagcggcaagctctgccaatcacaattgatggcgcaacttatgatgtgtctgcttgggtcaatcaccaccctggaggagctgacattatcgagaactatcgcaaccgcgatgcgaccgatgtcttcatggtgatgcactctcaagaagccgtcgccaagttgaagagaatgcctgttatggagccttcctctcctgacacacctgttgcacccaagcctaagcgtgatgagccccaggaggatttccgcaagttgcgggaggaattcatctccaagggtatgttcgagacgagtttcctttggtatttttacaagacttcaactaccgtcggtttgatggtcctttccatcttgatgaccgtgtacacgaattggtatttcaccgctgctttggttcttggcgtgtgctaccaacagctaggctggttgtcccacgactattgccatcaccaggttttcacaaaccgcaagattaacgacgctttcggtctctttttcggtaacgtgatgcagggatactcacagacttggtggaaggataggcacaatggtcaccatgccgccaccaatgtggtcggccatgacccagatattgataacctccccatcctggcttggtctcccgaagatgtcaagagggctactccttcgactcggaatctcatcaagtaccagcagtactacttcattcccaccattgcatcccttaggttcatctggtgcctccaatccatcggcggcgtcatgtcctacaagagcgaggagaggaacctgtactacaagcgccagtacactaaggaggcgattggtctggccctccactgggtgctcaaggccactttctattgcagtgccatgcctagctttgccaccggtttgggatgcttcttgatctccgagctgctcggaggatttggcattgccatcgttgtgtttctgaatcactatcctttggacaaggttgaggagactgtctgggatgagcacgggttcagcgccagccagatccacgagacgttgaacattaagcccggccttctcaccgattgggtctttggtggtctcaactaccagattgagcaccacttgtggcccaacatgcccaggcacaacctcacggcagcttccctggaggtgcagaagttgtgcgccaagcacaacctgccctacagggccccagccatcatccccggggttcagaaattggtcagcttcttaggcgagattgcccagctggctgctgtccctgaatgagcggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacctgcaggtcgactcgacgtacgatcccacatgcaagtttttatttcaatcccttttcctttgaataactgaccaagaacaacaagaaaaaaaaaaaaaaagaaaaggatcattttgaaaggatatttttcgctcctattcaaatactgtatttttaccaaaaaaactgtatttttcctacactctcaagctttgtttttcgcttcgactctcatgatttccttcatatgccaatcactctatttataaatggcataaggtagtgtgaacaattgcaaagcttgtcatcaaaagcttgcaatgtacaaattaatgtttttcatgcctttcaaaattatctgcaccccctagctattaatctaacatctaagtaaggctagtgaattttttcgaatagtcatgcagtgcattaatttccccgtgactattttggctttgactccaacactggccccgtacatccgtccctcattacatgaaaagaaatattgtttatattcttaattaaaaatattgtcccttctaaattttcatatagttaattattatattacttttttctctattctattagttctattttcaaattattatttatgcatatgtaaagtacattatatttttgctatatacttaaatatttctaaattattaaaaaaagactgatatgaaaaatttattctttttaaagctatatcattttatatatactttttcttttcttttctttcattttctattcaatttaataagaaataaattttgtaaatttttatttatcaatttataaaaatattttactttatatgttttttcacatttttgttaaacaaatcatatcattatgattgaaagagaggaaattgacagtgagtaataagtgatgagaaaaaaatgtgttatttcctaaaaaaaacctaaacaaacatgtatctactctctatttcatctatctctcatttcatttttctctttatctctttctttatttttttatcatatcatttcacattaattatttttactctctttattttttctctctatccctctcttatttccactcatatatacactccaaaattggggcatgcctttatcactactctatctcctccactaaatcatttaaatgaaactgaaaagcattggcaagtctcctcccctcctcaagtgatttccaactcagcattggcatctaattgattcagtatatctattgcatgtgtaaaagtctttccacaatacataactattaattaatcttaaataaataaaggataaaatatttttttttcttcataaaattaaaatatgttattttttgtttagatgtatattcgaataaatctaaatatatgataatgattttttatattgattaaacatataatcaatattaaatatgatatttttttatataggttgtacacataattttataaggataaaaaatatgataaaaataaattttaaatatttttatatttacgagaaaaaaaaatattttagccataaataaatgaccagcatattttacaaccttagtaattcataaattcctatatgtatatttgaaattaaaaacagataatcgttaagggaaggaatcctacgtcatctcttgccatttgtttttcatgcaaacagaaagggacgaaaaaccacctcaccatgaatcactcttcacaccatttttactagcaaacaagtctcaacaactgaagccagctctctttccgtttctttttacaacactttctttgaaatagtagtatttttttttcacatgatttattaacgtgccaaaagatgcttattgaatagagtgcacatttgtaatgtactactaattagaacatgaaaaagcattgttctaacacgataatcctgtgaaggcgttaactccaaagatccaatttcactatataaattgtgacgaaagcaaaatgaattcacatagctgagagagaaaggaaaggttaactaagaagcaatacttcagcggccgcaccatggctctcagtcttaccacagaacagctgttagaacgccctgatttggttgcgattgatggcatcctctacgaccttgaagggcttgccaaagttcatccaggaggagatttgattctcgcttctggtgcctctgatgcctcccctctcttttattcgatgcatccatacgtcaaaccggagaattccaaattgcttcaacagttcgtccgagggaagcatgaccgcacctcgaaggacattgtctacacgtatgattctcccttcgcacaagacgttaagcggacaatgcgcgaggtgatgaaagggaggaactggtacgcaacccctggcttctggctgcgcaccgttgggatcatcgccgtgacggccttttgcgagtggcactgggctaccacggggatggtgctgtggggcctgctgactggattcatgcacatgcagatcggcttatccatccagcatgatgcgtcccacggggccatcagcaagaagccttgggtcaacgccctcttcgcctacggcattgacgtcatcggatcgtcccggtggatttggctgcagtcgcacatcatgcggcaccacacctacaccaaccagcacggcctcgacctggatgcggagtcggcagagccgttcctggtgttccacaactaccccgccgcaaacaccgcccgaaagtggttccaccgcttccaagcttggtacatgtaccttgtgctgggggcatacggggtatcgctggtgtacaacccgctctacattttccggatgcagcacaatgacaccatcccagagtctgtcacggccatgcgggagaatggctttctgcggcgctaccgcacacttgcattcgtgatgcgagctttcttcatcttccggaccgcattcttgccctggtacctcactgggacctcattgctgatcaccattcctctggtgcccactgcaactggtgccttcttgacgttcttcttcattttgtcccacaattttgatggctccgaacggatccccgacaagaactgcaaggttaagagctctgagaaggacgttgaggctgaccaaattgactggtatcgggcgcaggtggagacgtcctccacatacggtggccccatcgccatgttcttcactggcggtctcaatttccagatcgagcaccacctctttccccggatgtcgtcttggcactaccccttcgtccagcaggcggtccgggagtgttgcgaacgccatggagtgcgatatgttttctatcctaccatcgtcggcaacatcatctccaccctgaagtacatgcataaggtgggtgtcgtccactgcgtgaaggacgcacaggattcctgagcggccgcatgagccgtaaaggttcaatacaacgagtgcttgttttcttagggacaagcattgtacttatgtatgattctgtgtaaccatgagtcttccacgttgtactaatgtgaagggcaaaaataaaacacagaacaagttcgtttttctcaaataatgtgaaggtagaaaatggaaccatgcctcctctcttgcatgtgatttaaaatattagcagatggtacc

SEQ ID NO: 18 - DNA, 13153 bp, Artificial Sequence
  plasmid BC-Tpom_Ann-EgD5_ALSrev
gtacgtctagaggatccgtcgacggcgcgcccgatcatccggatatagttcctcctttcagcaaaaaacccctcaagacccgtttagaggccccaaggggttatgctagttattgctcagcggtggcagcagccaactcagcttcctttcgggctttgttagcagccggatcgatccaagctgtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggcttttccatgggtatatctccttcttaaagttaaacaaaattatttctagagggaaaccgttgtggtctccctatagtgagtcgtattaatttcgcgggatcgagatctgatcaacctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatggacatattgtcgttagaacgcggctacaattaatacataaccttatgtatcatacacatacgatttaggtgacactatagaacggcgcgccaagctgggtctagaactagaaacgtgatgccacttgttattgaagtcgattacagcatctattctgttttactatttataactttgccatttctgacttttgaaaactatctctggatttcggtatcgctttgtgaagatcgagcaaaagagacgttttgtggacgcaatggtccaaatccgttctacatgaacaaattggtcacaatttccactaaaagtaaataaatggcaagttaaaaaaggaatatgcattttactgattgcctaggtgagctccaagagaagttgaatctacacgtctaccaaccgctaaaaaaagaaaaacattgatatgtaacctgattccattagcttttgacttcttcaacagattctctacttagatttctaacagaaatattattactagcacatcattttcagtctcactacagcaaaaaatccaacggcacaatacagacaacaggagatatcagactacagagatagatagatgctactgcatgtagtaagttaaataaaaggaaaataaaatgtcttgctaccaaaactactacagactatgatgctcaccacaggccaaatcctgcaactaggacagcattatcttatatatattgtacaaaacaagcatcaaggaacatttggtctaggcaatcagtacctcgttctaccatcaccctcagttatcacatccttgaaggatccattactgggaatcatcggcaacacatgctcctgatggggcacaatgacatcaagaaggtaggggccaggggtgtccaacattctctgaattgccgctctaagctcttccttcttcgtcactcgcgctgccggtatcccacaagcatcagcaaacttgagcatgtttgggaatatctcgctctcgctagacggatctccaagataggtgtgagctctattggacttgtagaacctatcctccaactgaaccaccatacccaaatgctgattgttcaacaacaatatcttaactgggagattctccactcttatagtggccaactcctgaacattcatgatgaaactaccatccccatcaatgtcaaccacaacagccccagggttagcaacagcagcaccaatagccgcaggcaatccaaaacccatggctccaagaccccctgaggtcaaccactgcctcggtctcttgtacttgtaaaactgcgcagcccacatttgatgctgcccaaccccagtactaacaatagcatctccattagtcaactcatcaagaacctcgatagcatgctgcggagaaatcgcgtcctggaatgtcttgtaacccaatggaaacttgtgtttctgcacattaatctcttctctccaacctccaagatcaaacttaccctccactcctttctcctccaaaatcatattaattcccttcaaggccaacttcaaatccgcgcaaaccgacacgtgcgcctgcttgttcttcccaatctcggcagaatcaatatcaatgtgaacaatcttagccctactagcaaaagcctcaagcttcccagtaacacggtcatcaaaccttaccccaaaggcaagcaacaaatcactattgtcaacagcatagttagcataaacagtaccatgcatacccagcatctgaagggaatattcatcaccaataggaaaagttccaagacccattaaagtgctagcaacgggaataccagtgagttcaacaaagcgcctcaattcagcactggaattcaaactgccaccgccgacgtagagaacgggcttttgggcctccatgatgagtctgacaatgtgttccaattgggcctcggcggggggcctgggcagcctggcgaggtaaccggggaggttaacgggctcgtcccaattaggcacggcgagttgctgctgaacgtctttgggaatgtcgatgaggaccggaccggggcggccggaggtggcgacgaagaaagcctcggcgacgacgcgggggatgtcgtcgacgtcgaggatgaggtagttgtgcttcgtgatggatctgctcacctccacgatcggggtttcttggaaggcgtcggtgccgatcatccggcgggcgacctggccggtgatggcgacgactgggacgctgtccattaaagcgtcggcgaggccgctcacgaggttggtggcgccggggccggaggtggcaatgcagacgccggggaggccggaggaacgcgcgtagccttcggcggcgaagacgccgccctgctcgtggcgcgggagcacgttgcggatggcggcggagcgcgtgagcgcctggtggatctccatcgacgcaccgccggggtacgcgaacaccgtcgtcacgccctgcctctccagcgcctccacaaggatgtccgcgcccttgcgaggttcgccggaggcgaaccgtgacacgaagggctccgtggtcggcgcttccttggtgaagggcgccgccgtggggggtttggagatggaacatttgattttgagagcgtggttgggtttggtgagggtttgatgagagagagggagggtggatctagtaatgcgtttggggaaggtggggtgtgaagaggaagaagagaatcgggtggttctggaagcggtggccgccattgtgttgtgtggcatggttatacttcaaaaactgcacaacaagcctagagttagtacctaaacagtaaatttacaacagagagcaaagacacatgcaaaaatttcagccataaaaaaagttataatagaatttaaagcaaaagtttcattttttaaacatatatacaaacaaactggatttgaaggaagggattaattcccctgctcaaagtttgaattcctattgtgacctatactcgaataaaattgaagcctaaggaatgtatgagaaacaagaaaacaaaacaaaactacagacaaacaagtacaattacaaaattcgctaaaattctgtaatcaccaaaccccatctcagtcagcacaaggcccaaggtttattttgaaataaaaaaaaagtgattttatttctcataagctaaaagaaagaaaggcaattatgaaatgatttcgactagatctgaaagtccaacgcgtattccgcagatattaaagaaagagtagagtttcacatggatcctagatggacccagttgaggaaaaagcaaggcaaagcaaaccagaagtgcaagatccgaaattgaaccacggaatctaggatttggtagagggagaagaaaagtaccttgagaggtagaagagaagagaagagcagagagatatatgaacgagtgtgtcttggtctcaactctgaagcgatacgagtttagaggggagcattgagttccaatttatagggaaaccgggtggcaggggtgagttaatgacggaaaagcccctaagtaacgagattggattgtgggttagattcaaccgtttgcatccgcggcttagattggggaagtcagagtgaatctcaaccgttgactgagttgaaaattgaatgtagcaaccaattgagccaaccccagcctttgccctttgattttgatttgtttgttgcatactttttatttgtcttctggttctgactctctttctctcgtttcaatgccaggttgcctactcccacaccactcacaagaagattctactgttagtattaaatattttttaatgtattaaatgatgaatgcttttgtaaacagaacaagactatgtctaataagtgtcttgcaacattttttaagaaattaaaaaaaatatatttattatcaaaatcaaatgtatgaaaaatcatgaataatataattttatacatttttttaaaaaatcttttaatttcttaattaatatcttaaaaataatgattaatatttaacccaaaataattagtatgattggtaaggaagatatccatgttatgtttggatgtgagtttgatctagagcaaagcttactagagtcgacctgcaggttgaaacatccctgaagtgtctcattttattttatttattctttgctgataaaaaaataaaataaaagaagctaagcacacggtcaaccattgctctactgctaaaagggttatgtgtagtgttttactgcataaattatgcagcaaacaagacaactcaaattaaaaaatttcctttgcttgtttttttgttgtctctgacttgactttcttgtggaagttggttgtataaggattgggacaccattgtccttcttaatttaattttattctttgctgataaaaaaaaaaatttcatatagtgttaaataataatttgttaaataaccaaaaagtcaaatatgtttactctcgtttaaataattgagattcgtccagcaaggctaaacgattgtatagatttatgacaatatttacttttttatagataaatgttatattataataaatttatatacatatattatatgttatttattattattttaaatccttcaatattttatcaaaccaactcataattttttttttatctgtaagaagcaataaaattaaatagacccactttaaggatgatccaacctttatacagagtaagagagttcaaatagtaccctttcatatacatatcaactaaaatattagaaatatcatggatcaaaccttataaagacattaaataagtggataagtataatatataaatgggtagtatataatatataaatggatacaaacttctctctttataattgttatgtctccttaacatcctaatataatacataagtgggtaatatataatatataaatggagacaaacttcttccattataattgttatgtcttcttaacacttatgtctcgttcacaatgctaaggttagaattgtttagaaagtcttatagtacacatttgtttttgtactatttgaagcattccataagccgtcacgattcagatgatttataataataagaggaaatttatcatagaacaataaggtgcatagatagagtgttaatatatcataacatcctttgtttattcatagaagaagtgagatggagctcagttattatactgttacatggtcggatacaatattccatgctctccatgagctcttacacctacatgcattttagttcatacttgcggccgctcattcagggacagcagccagctgggcaatctcgcctaagaagctgaccaatttctgaaccccggggatgatggctggggccctgtagggcaggttgtgcttggcgcacaacttctgcacctccagggaagctgccgtgaggttgtgcctgggcatgttgggccacaagtggtgctcaatctggtagttgagaccaccaaagacccaatcggtgagaaggccgggcttaatgttcaacgtctcgtggatctggctggcgctgaacccgtgctcatcccagacagtctcctcaaccttgtccaaaggatagtgattcagaaacacaacgatggcaatgccaaatcctccgagcagctcggagatcaagaagcatcccaaaccggtggcaaagctaggcatggcactgcaatagaaagtggccttgagcacccagtggagggccagaccaatcgcctccttagtgtactggcgcttgtagtacaggttcctctcctcgctcttgtaggacatgacgccgccgatggattggaggcaccagatgaacctaagggatgcaatggtgggaatgaagtagtactgctggtacttgatgagattccgagtcgaaggagtagccctcttgacatcttcgggagaccaagccaggatggggaggttatcaatatctgggtcatggccgaccacattggtggcggcatggtgaccattgtgcctatccttccaccaagtctgtgagtatccctgcatcacgttaccgaaaaagagaccgaaagcgtcgttaatcttgcggtttgtgaaaacctggtgatggcaatagtcgtgggacaaccagcctagctgttggtagcacacgccaagaaccaaagcagcggtgaaataccaattcgtgtacacggtcatcaagatggaaaggaccatcaaaccgacggtagttgaagtcttgtaaaaataccaaaggaaactcgtctcgaacatacccttggagatgaattcctcccgcaacttgcggaaatcctcctggggctcatcacgcttaggcttgggtgcaacaggtgtgtcaggagaggaaggctccataacaggcattctcttcaacttggcgacggcttcttgagagtgcatcaccatgaagacatcggtcgcatcgcggttgcgatagttctcgataatgtcagctcctccagggtggtgattgacccaagcagacacatcataagttgcgccatcaattgtgattggcagagcttgccgcttaggagacatggtgcggccgcagtatatcttaaattctttaatacggtgtactaggatattgaactggttcttgatgatgaaaacctgggccgagattgcagctatttatagtcataggtcttgttaacatgcatggacatttggccacggggtggcatgcagtttgacgggtgttgaaataaacaaaaatgaggtggcggaagagaatacgagtttgaggttgggttagaaacaacaaatgtgagggctcatgatgggttgagttggtgaatgttttgggctgctcgattgacacctttgtgagtacgtgttgttgtgcatggcttttggggtccagtttttttttcttgacgcggcgatcctgatcagctagtggataagtgatgtccactgtgtgtgattgcgtttttgtttgaattttatgaacttagacattgctatgcaaaggatactctcattgtgttttgtcttcttttgttccttggctttttcttatgatccaagagactagtcagtgttgtggcattcgagactaccaagattaattatgatgggggaaggataagtaactgattagtacggactgttaccaaattaattaataagcggcaaatgaagggcatggatcctgcaggtcgactcgacgtacgatcccacatgcaagtttttatttcaatcccttttcctttgaataactgaccaagaacaacaagaaaaaaaaaaaaaaagaaaaggatcattttgaaaggatatttttcgctcctattcaaatactgtatttttaccaaaaaaactgtatttttcctacactctcaagctttgtttttcgcttcgactctcatgatttccttcatatgccaatcactctatttataaatggcataaggtagtgtgaacaattgcaaagcttgtcatcaaaagcttgcaatgtacaaattaatgtttttcatgcctttcaaaattatctgcaccccctagctattaatctaacatctaagtaaggctagtgaattttttcgaatagtcatgcagtgcattaatttccccgtgactattttggctttgactccaacactggccccgtacatccgtccctcattacatgaaaagaaatattgtttatattcttaattaaaaatattgtcccttctaaattttcatatagttaattattatattacttttttctctattctattagttctattttcaaattattatttatgcatatgtaaagtacattatatttttgctatatacttaaatatttctaaattattaaaaaaagactgatatgaaaaatttattctttttaaagctatatcattttatatatactttttcttttcttttctttcattttctattcaatttaataagaaataaattttgtaaatttttatttatcaatttataaaaatattttactttatatgttttttcacatttttgttaaacaaatcatatcattatgattgaaagagaggaaattgacagtgagtaataagtgatgagaaaaaaatgtgttatttcctaaaaaaaacctaaacaaacatgtatctactctctatttcatctatctctcatttcatttttctctttatctctttctttatttttttatcatatcatttcacattaattatttttactctctttattttttctctctatccctctcttatttccactcatatatacactccaaaattggggcatgcctttatcactactctatctcctccactaaatcatttaaatgaaactgaaaagcattggcaagtctcctcccctcctcaagtgatttccaactcagcattggcatctaattgattcagtatatctattgcatgtgtaaaagtctttccacaatacataactattaattaatcttaaataaataaaggataaaatatttttttttcttcataaaattaaaatatgttattttttgtttagatgtatattcgaataaatctaaatatatgataatgattttttatattgattaaacatataatcaatattaaatatgatatttttttatataggttgtacacataattttataaggataaaaaatatgataaaaataaattttaaatatttttatatttacgagaaaaaaaaatattttagccataaataaatgaccagcatattttacaaccttagtaattcataaattcctatatgtatatttgaaattaaaaacagataatcgttaagggaaggaatcctacgtcatctcttgccatttgtttttcatgcaaacagaaagggacgaaaaaccacctcaccatgaatcactcttcacaccatttttactagcaaacaagtctcaacaactgaagccagctctctttccgtttctttttacaacactttctttgaaatagtagtatttttttttcacatgatttattaacgtgccaaaagatgcttattgaatagagtgcacatttgtaatgtactactaattagaacatgaaaaagcattgttctaacacgataatcctgtgaaggcgttaactccaaagatccaatttcactatataaattgtgacgaaagcaaaatgaattcacatagctgagagagaaaggaaaggttaactaagaagcaatacttcagcggccgcaccatggctctcagtcttaccacagaacagctgttagaacgccctgatttggttgcgattgatggcatcctctacgaccttgaagggcttgccaaagttcatccaggaggagatttgattctcgcttctggtgcctctgatgcctcccctctcttttattcgatgcatccatacgtcaaaccggagaattccaaattgcttcaacagttcgtccgagggaagcatgaccgcacctcgaaggacattgtctacacgtatgattctcccttcgcacaagacgttaagcggacaatgcgcgaggtgatgaaagggaggaactggtacgcaacccctggcttctggctgcgcaccgttgggatcatcgccgtgacggccttttgcgagtggcactgggctaccacggggatggtgctgtggggcctgctgactggattcatgcacatgcagatcggcttatccatccagcatgatgcgtcccacggggccatcagcaagaagccttgggtcaacgccctcttcgcctacggcattgacgtcatcggatcgtcccggtggatttggctgcagtcgcacatcatgcggcaccacacctacaccaaccagcacggcctcgacctggatgcggagtcggcagagccgttcctggtgttccacaactaccccgccgcaaacaccgcccgaaagtggttccaccgcttccaagcttggtacatgtaccttgtgctgggggcatacggggtatcgctggtgtacaacccgctctacattttccggatgcagcacaatgacaccatcccagagtctgtcacggccatgcgggagaatggctttctgcggcgctaccgcacacttgcattcgtgatgcgagctttcttcatcttccggaccgcattcttgccctggtacctcactgggacctcattgctgatcaccattcctctggtgcccactgcaactggtgccttcttgacgttcttcttcattttgtcccacaattttgatggctccgaacggatccccgacaagaactgcaaggttaagagctctgagaaggacgttgaggctgaccaaattgactggtatcgggcgcaggtggagacgtcctccacatacggtggccccatcgccatgttcttcactggcggtctcaatttccagatcgagcaccacctctttccccggatgtcgtcttggcactaccccttcgtccagcaggcggtccgggagtgttgcgaacgccatggagtgcgatatgttttctatcctaccatcgtcggcaacatcatctccaccctgaagtacatgcataaggtgggtgtcgtccactgcgtgaaggacgcacaggattcctgagcggccgcatgagccgtaaaggttcaatacaacgagtgcttgttttcttagggacaagcattgtacttatgtatgattctgtgtaaccatgagtcttccacgttgtactaatgtgaagggcaaaaataaaacacagaacaagttcgtttttctcaaataatgtgaaggtagaaaatggaaccatgcctcctctcttgcatgtgatttaaaatattagcagatggtacc

SEQ ID NO: 19 - DNA, 4975 bp, Artificial Sequence
  plasmid KS133
  misc_feature (3952)..(3952): n is a, c, g, or t
ggccgccgactcgacgatgagcgagatgaccagctccggccgcgacacaagtgtgagagtactaaataaatgctttggttgtacgaaatcattacactaaataaaataatcaaagcttatatatgccttccgctaaggccgaatgcaaagaaattggttctttctcgttatcttttgccacttttactagtacgtattaattactacttaatcatctttgtttacggctcattatatccgtcgacggcgcgcccgatcatccggatatagttcctcctttcagcaaaaaacccctcaagacccgtttagaggccccaaggggttatgctagttattgctcagcggtggcagcagccaactcagcttcctttcgggctttgttagcagccggatcgatccaagctgtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggcttttccatgggtatatctccttcttaaagttaaacaaaattatttctagagggaaaccgttgtggtctccctatagtgagtcgtattaatttcgcgggatcgagatctgatcaacctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatggacatattgtcgttagaacgcggctacaattaatacataaccttatgtatcatacacatacgatttaggtgacactatagaacggcgcgccaagcttggatcctcgaagagaagggttaataacacacttttttaacatttttaacacaaattttagttatttaaaaatttattaaaaaatttaaaataagaagaggaactctttaaataaatctaacttacaaaatttatgatttttaataagttttcaccaataaaaaatgtcataaaaatatgttaaaaagtatattatcaatattctctttatgataaataaaaagaaaaaaaaaataaaagttaagtgaaaatgagattgaagtgactttaggtgtgtataaatatatcaaccccgccaacaatttatttaatccaaatatattgaagtatattattccatagcctttatttatttatatatttattatataaaagctttatttgttctaggttgttcatgaaatatttttttggttttatctccgttgtaagaaaatcatgtgctttgtgtcgccactcactattgcagctttttcatgcattggtcagattgacggttgattgtatttttgttttttatggttttgtgttatgacttaagtcttcatctctttatctcttcatcaggtttgatggttacctaatatggtccatgggtacatgcatggttaaattaggtggccaactttgttgtgaacgatagaattttttttatattaagtaaactatttttatattatgaaataataataaaaaaaatattttatcattattaacaaaatcatattagttaatttgttaactctataataaaagaaatactgtaacattcacattacatggtaacatctttccaccctttcatttgttttttgtttgatgactttttttcttgtttaaatttatttcccttcttttaaatttggaatacattatcatcatatataaactaaaatactaaaaacaggattacacaaatgataaataataacacaaatatttataaatctagctgcaatatatttaaactagctatatcgatattgtaaaataaaactagctgcattgatactgataaaaaaatatcatgtgctttctggactgatgatgcagtatacttttgacattgcctttattttatttttcagaaaagctttcttagttctgggttcttcattatttgtttcccatctccattgtgaattgaatcatttgcttcgtgtcacaaatacaatttagntaggtacatgcattggtcagattcacggtttattatgtcatgacttaagttcatggtagtacattacctgccacgcatgcattatattggttagatttgataggcaaatttggttgtcaacaatataaatataaataatgtttttatattacgaaataacagtgatcaaaacaaacagttttatctttattaacaagattttgtttttgtttgatgacgttttttaatgtttacgctttcccccttcttttgaatttagaacactttatcatcataaaatcaaatactaaaaaaattacatatttcataaataataacacaaatatttttaaaaaatctgaaataataatgaacaatattacatattatcacgaaaattcattaataaaaatattatataaataaaatgtaatagtagttatatgtaggaaaaaagtactgcacgcataatatatacaaaaagattaaaatgaactattataaataataacactaaattaatggtgaatcatatcaaaataatgaaaaagtaaataaaatttgtaattaacttctatatgtattacacacacaaataataaataatagtaaaaaaaattatgataaatatttaccatctcataagatatttaaaataatgataaaaatatagattattttttatgcaactagctagccaaaaagagaacacgggtatatataaaaagagtacctttaaattctactgtacttcctttattcctgacgtttttatatcaagtggacatacgtgaagattttaattatcagtctaaatatttcattagcacttaatacttttctgttttattcctatcctataagtagtcccgattctcccaacattgcttattcacacaactaactaagaaagtcttccatagccccccaagcggccggagctggtcatctcgctcatcgtcgagtcggcggccggagctggtcatctcgctcatcgtcgagtcggcggccgccgactcgacgatgagcgagatgaccagctcc

SEQ ID NO: 20 - DNA, 5626 bp, Artificial Sequence
  plasmid KS263
  misc_feature (3989)..(3989): n is a, c, g, or t
ggccgccgactcgacgatgagcgagatgaccagctccggccgccgactcgacgatgagcgagatgaccagctccggccgcgacacaagtgtgagagtactaaataaatgctttggttgtacgaaatcattacactaaataaaataatcaaagcttatatatgccttccgctaaggccgaatgcaaagaaattggttctttctcgttatcttttgccacttttactagtacgtattaattactacttaatcatctttgtttacggctcattatatccgtcgacggcgcgcccgatcatccggatatagttcctcctttcagcaaaaaacccctcaagacccgtttagaggccccaaggggttatgctagttattgctcagcggtggcagcagccaactcagcttcctttcgggctttgttagcagccggatcgatccaagctgtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggcttttccatgggtatatctccttcttaaagttaaacaaaattatttctagagggaaaccgttgtggtctccctatagtgagtcgtattaatttcgcgggatcgagatctgatcaacctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatggacatattgtcgttagaacgcggctacaattaatacataaccttatgtatcatacacatacgatttaggtgacactatagaacggcgcgccaagcttggatcctcgaagagaagggttaataacacacttttttaacatttttaacacaaattttagttatttaaaaatttattaaaaaatttaaaataagaagaggaactctttaaataaatctaacttacaaaatttatgatttttaataagttttcaccaataaaaaatgtcataaaaatatgttaaaaagtatattatcaatattctctttatgataaataaaaagaaaaaaaaaataaaagttaagtgaaaatgagattgaagtgactttaggtgtgtataaatatatcaaccccgccaacaatttatttaatccaaatatattgaagtatattattccatagcctttatttatttatatatttattatataaaagctttatttgttctaggttgttcatgaaatatttttttggttttatctccgttgtaagaaaatcatgtgctttgtgtcgccactcactattgcagctttttcatgcattggtcagattgacggttgattgtatttttgttttttatggttttgtgttatgacttaagtcttcatctctttatctcttcatcaggtttgatggttacctaatatggtccatgggtacatgcatggttaaattaggtggccaactttgttgtgaacgatagaattttttttatattaagtaaactatttttatattatgaaataataataaaaaaaatattttatcattattaacaaaatcatattagttaatttgttaactctataataaaagaaatactgtaacattcacattacatggtaacatctttccaccctttcatttgttttttgtttgatgactttttttcttgtttaaatttatttcccttcttttaaatttggaatacattatcatcatatataaactaaaatactaaaaacaggattacacaaatgataaataataacacaaatatttataaatctagctgcaatatatttaaactagctatatcgatattgtaaaataaaactagctgcattgatactgataaaaaaatatcatgtgctttctggactgatgatgcagtatacttttgacattgcctttattttatttttcagaaaagctttcttagttctgggttcttcattatttgtttcccatctccattgtgaattgaatcatttgcttcgtgtcacaaatacaatttagntaggtacatgcattggtcagattcacggtttattatgtcatgacttaagttcatggtagtacattacctgccacgcatgcattatattggttagatttgataggcaaatttggttgtcaacaatataaatataaataatgtttttatattacgaaataacagtgatcaaaacaaacagttttatctttattaacaagattttgtttttgtttgatgacgttttttaatgtttacgctttcccccttcttttgaatttagaacactttatcatcataaaatcaaatactaaaaaaattacatatttcataaataataacacaaatatttttaaaaaatctgaaataataatgaacaatattacatattatcacgaaaattcattaataaaaatattatataaataaaatgtaatagtagttatatgtaggaaaaaagtactgcacgcataatatatacaaaaagattaaaatgaactattataaataataacactaaattaatggtgaatcatatcaaaataatgaaaaagtaaataaaatttgtaattaacttctatatgtattacacacacaaataataaataatagtaaaaaaaattatgataaatatttaccatctcataagatatttaaaataatgataaaaatatagattattttttatgcaactagctagccaaaaagagaacacgggtatatataaaaagagtacctttaaattctactgtacttcctttattcctgacgtttttatatcaagtggacatacgtgaagattttaattatcagtctaaatatttcattagcacttaatacttttctgttttattcctatcctataagtagtcccgattctcccaacattgcttattcacacaactaactaagaaagtcttccatagccccccaagcggccggagctggtcatctcgctcatcgtcgagtcggcggccggagctggtcatctcgctcatcgtcgagtcggcggccctcctccaccgtttaagattgcagaaatcagagcttcaataccaaaacattgctgggtcaagaatccatggagatccctcagttatgttctcagggatgtgcttgtaattgctgcattggtggctgcagcaattcacttcgacaactggcttctctggctaatctattgccccattcaaggcacaatgttctgggctctctttgttcttggacatgattgtggccatggaagcttttcagatagccctttgctgaatagcctggtgggacacatcttgcattcctcaattcttgtgccataccatggatggagaattagccacagaactcaccatcaaaaccatggacacattgagaaggatgagtcatgggttccattaacagagaagatttacaagaatctagacagcatgacaagactcattagattcactgtgccatttccattgtttgtgtatccaatttatttgttttcaagaagccccggaaaggaaggctctcacttcaatccctacagcaatctgttcccacccagtgagagaaaaggaatagcaatatcaacactgtgttgggctaccatgttttctctgcttatctatctctcattcataactagtccacttctagtgctcaagctctatggaatt

SEQ ID NO: 21 - DNA, 17 bp, Artificial Sequence
  primer ELfad3-5Not
ccccaagcggccgcagc

SEQ ID NO: 22 - DNA, 20 bp, Artificial Sequence
  primer ELfad3-3Not
acttgtgtcgcggccgcagc

SEQ ID NO: 23 - DNA, 807 bp, Artificial Sequence
  ELVISLIVES/fad3 cassette ELfad3Not
gcggccggagctggtcatctcgctcatcgtcgagtcggcggccggagctggtcatctcgctcatcgtcgagtcggcggccctcctccaccgtttaagattgcagaaatcagagcttcaataccaaaacattgctgggtcaagaatccatggagatccctcagttatgttctcagggatgtgcttgtaattgctgcattggtggctgcagcaattcacttcgacaactggcttctctggctaatctattgccccattcaaggcacaatgttctgggctctctttgttcttggacatgattgtggccatggaagcttttcagatagccctttgctgaatagcctggtgggacacatcttgcattcctcaattcttgtgccataccatggatggagaattagccacagaactcaccatcaaaaccatggacacattgagaaggatgagtcatgggttccattaacagagaagatttacaagaatctagacagcatgacaagactcattagattcactgtgccatttccattgtttgtgtatccaatttatttgttttcaagaagccccggaaaggaaggctctcacttcaatccctacagcaatctgttcccacccagtgagagaaaaggaatagcaatatcaacactgtgttgggctaccatgttttctctgcttatctatctctcattcataactagtccacttctagtgctcaagctctatggaattggccgccgactcgacgatgagcgagatgaccagctccggccgccgactcgacgatgagcgagatgaccagctccggccgc

SEQ ID NO: 24 - DNA, 4480 bp, Artificial Sequence
  primer pKR179
ctagacctgcaggatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacctgcaggtctagaggatccccgggtaccgagctcgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttgcatgcctgcaggtcgact

SEQ ID NO: 25 - DNA, 5279 bp, Artificial Sequence
  primer BC-ELfad3
ctagacctgcaggatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcagctggtcatctcgctcatcgtcgagtcggcggccggagctggtcatctcgctcatcgtcgagtcggcggccctcctccaccgtttaagattgcagaaatcagagcttcaataccaaaacattgctgggtcaagaatccatggagatccctcagttatgttctcagggatgtgcttgtaattgctgcattggtggctgcagcaattcacttcgacaactggcttctctggctaatctattgccccattcaaggcacaatgttctgggctctctttgttcttggacatgattgtggccatggaagcttttcagatagccctttgctgaatagcctggtgggacacatcttgcattcctcaattcttgtgccataccatggatggagaattagccacagaactcaccatcaaaaccatggacacattgagaaggatgagtcatgggttccattaacagagaagatttacaagaatctagacagcatgacaagactcattagattcactgtgccatttccattgtttgtgtatccaatttatttgttttcaagaagccccggaaaggaaggctctcacttcaatccctacagcaatctgttcccacccagtgagagaaaaggaatagcaatatcaacactgtgttgggctaccatgttttctctgcttatctatctctcattcataactagtccacttctagtgctcaagctctatggaattggccgccgactcgacgatgagcgagatgaccagctccggccgccgactcgacgatgagcgagatgaccagctgcggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacctgcaggtctagaggatccccgggtaccgagctcgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttgcatgcctgcaggtcgact

SEQ ID NO: 26 - DNA, 12582 bp, Artificial Sequence
  plasmid BC-Tpom_Ann-HPfad3ABA'_ALS
gtacgtctagaggatccgtcgacggcgcgcccgatcatccggatatagttcctcctttcagcaaaaaacccctcaagacccgtttagaggccccaaggggttatgctagttattgctcagcggtggcagcagccaactcagcttcctttcgggctttgttagcagccggatcgatccaagctgtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggcttttccatgggtatatctccttcttaaagttaaacaaaattatttctagagggaaaccgttgtggtctccctatagtgagtcgtattaatttcgcgggatcgagatctgatcaacctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatggacatattgtcgttagaacgcggctacaattaatacataaccttatgtatcatacacatacgatttaggtgacactatagaacggcgcgccaagctgggtctagaactagaaacgtgatgccacttgttattgaagtcgattacagcatctattctgttttactatttataactttgccatttctgacttttgaaaactatctctggatttcggtatcgctttgtgaagatcgagcaaaagagacgttttgtggacgcaatggtccaaatccgttctacatgaacaaattggtcacaatttccactaaaagtaaataaatggcaagttaaaaaaggaatatgcattttactgattgcctaggtgagctccaagagaagttgaatctacacgtctaccaaccgctaaaaaaagaaaaacattgatatgtaacctgattccattagcttttgacttcttcaacagattctctacttagatttctaacagaaatattattactagcacatcattttcagtctcactacagcaaaaaatccaacggcacaatacagacaacaggagatatcagactacagagatagatagatgctactgcatgtagtaagttaaataaaaggaaaataaaatgtcttgctaccaaaactactacagactatgatgctcaccacaggccaaatcctgcaactaggacagcattatcttatatatattgtacaaaacaagcatcaaggaacatttggtctaggcaatcagtacctcgttctaccatcaccctcagttatcacatccttgaaggatccattactgggaatcatcggcaacacatgctcctgatggggcacaatgacatcaagaaggtaggggccaggggtgtccaacattctctgaattgccgctctaagctcttccttcttcgtcactcgcgctgccggtatcccacaagcatcagcaaacttgagcatgtttgggaatatctcgctctcgctagacggatctccaagataggtgtgagctctattggacttgtagaacctatcctccaactgaaccaccatacccaaatgctgattgttcaacaacaatatcttaactgggagattctccactcttatagtggccaactcctgaacattcatgatgaaactaccatccccatcaatgtcaaccacaacagccccagggttagcaacagcagcaccaatagccgcaggcaatccaaaacccatggctccaagaccccctgaggtcaaccactgcctcggtctcttgtacttgtaaaactgcgcagcccacatttgatgctgcccaaccccagtactaacaatagcatctccattagtcaactcatcaagaacctcgatagcatgctgcggagaaatcgcgtcctggaatgtcttgtaacccaatggaaacttgtgtttctgcacattaatctcttctctccaacctccaagatcaaacttaccctccactcctttctcctccaaaatcatattaattcccttcaaggccaacttcaaatccgcgcaaaccgacacgtgcgcctgcttgttcttcccaatctcggcagaatcaatatcaatgtgaacaatcttagccctactagcaaaagcctcaagcttcccagtaacacggtcatcaaaccttaccccaaaggcaagcaacaaatcactattgtcaacagcatagttagcataaacagtaccatgcatacccagcatctgaagggaatattcatcaccaataggaaaagttccaagacccattaaagtgctagcaacgggaataccagtgagttcaacaaagcgcctcaattcagcactggaattcaaactgccaccgccgacgtagagaacgggcttttgggcctccatgatgagtctgacaatgtgttccaattgggcctcggcggggggcctgggcagcctggcgaggtaaccggggaggttaacgggctcgtcccaattaggcacggcgagttgctgctgaacgtctttgggaatgtcgatgaggaccggaccggggcggccggaggtggcgacgaagaaagcctcggcgacgacgcgggggatgtcgtcgacgtcgaggatgaggtagttgtgcttcgtgatggatctgctcacctccacgatcggggtttcttggaaggcgtcggtgccgatcatccggcgggcgacctggccggtgatggcgacgactgggacgctgtccattaaagcgtcggcgaggccgctcacgaggttggtggcgccggggccggaggtggcaatgcagacgccggggaggccggaggaacgcgcgtagccttcggcggcgaagacgccgccctgctcgtggcgcgggagcacgttgcggatggcggcggagcgcgtgagcgcctggtggatctccatcgacgcaccgccggggtacgcgaacaccgtcgtcacgccctgcctctccagcgcctccacaaggatgtccgcgcccttgcgaggttcgccggaggcgaaccgtgacacgaagggctccgtggtcggcgcttccttggtgaagggcgccgccgtggggggtttggagatggaacatttgattttgagagcgtggttgggtttggtgagggtttgatgagagagagggagggtggatctagtaatgcgtttggggaaggtggggtgtgaagaggaagaagagaatcgggtggttctggaagcggtggccgccattgtgttgtgtggcatggttatacttcaaaaactgcacaacaagcctagagttagtacctaaacagtaaatttacaacagagagcaaagacacatgcaaaaatttcagccataaaaaaagttataatagaatttaaagcaaaagtttcattttttaaacatatatacaaacaaactggatttgaaggaagggattaattcccctgctcaaagtttgaattcctattgtgacctatactcgaataaaattgaagcctaaggaatgtatgagaaacaagaaaacaaaacaaaactacagacaaacaagtacaattacaaaattcgctaaaattctgtaatcaccaaaccccatctcagtcagcacaaggcccaaggtttattttgaaataaaaaaaaagtgattttatttctcataagctaaaagaaagaaaggcaattatgaaatgatttcgactagatctgaaagtccaacgcgtattccgcagatattaaagaaagagtagagtttcacatggatcctagatggacccagttgaggaaaaagcaaggcaaagcaaaccagaagtgcaagatccgaaattgaaccacggaatctaggatttggtagagggagaagaaaagtaccttgagaggtagaagagaagagaagagcagagagatatatgaacgagtgtgtcttggtctcaactctgaagcgatacgagtttagaggggagcattgagttccaatttatagggaaaccgggtggcaggggtgagttaatgacggaaaagcccctaagtaacgagattggattgtgggttagattcaaccgtttgcatccgcggcttagattggggaagtcagagtgaatctcaaccgttgactgagttgaaaattgaatgtagcaaccaattgagccaaccccagcctttgccctttgattttgatttgtttgttgcatactttttatttgtcttctggttctgactctctttctctcgtttcaatgccaggttgcctactcccacaccactcacaagaagattctactgttagtattaaatattttttaatgtattaaatgatgaatgcttttgtaaacagaacaagactatgtctaataagtgtcttgcaacattttttaagaaattaaaaaaaatatatttattatcaaaatcaaatgtatgaaaaatcatgaataatataattttatacatttttttaaaaaatcttttaatttcttaattaatatcttaaaaataatgattaatatttaacccaaaataattagtatgattggtaaggaagatatccatgttatgtttggatgtgagtttgatctagagcaaagcttactagagtcgacctgcaggttgaaacatccctgaagtgtctcattttattttatttattctttgctgataaaaaaataaaataaaagaagctaagcacacggtcaaccattgctctactgctaaaagggttatgtgtagtgttttactgcataaattatgcagcaaacaagacaactcaaattaaaaaatttcctttgcttgtttttttgttgtctctgacttgactttcttgtggaagttggttgtataaggattgggacaccattgtccttcttaatttaattttattctttgctgataaaaaaaaaaatttcatatagtgttaaataataatttgttaaataaccaaaaagtcaaatatgtttactctcgtttaaataattgagattcgtccagcaaggctaaacgattgtatagatttatgacaatatttacttttttatagataaatgttatattataataaatttatatacatatattatatgttatttattattattttaaatccttcaatattttatcaaaccaactcataattttttttttatctgtaagaagcaataaaattaaatagacccactttaaggatgatccaacctttatacagagtaagagagttcaaatagtaccctttcatatacatatcaactaaaatattagaaatatcatggatcaaaccttataaagacattaaataagtggataagtataatatataaatgggtagtatataatatataaatggatacaaacttctctctttataattgttatgtctccttaacatcctaatataatacataagtgggtaatatataatatataaatggagacaaacttcttccattataattgttatgtcttcttaacacttatgtctcgttcacaatgctaaggttagaattgtttagaaagtcttatagtacacatttgtttttgtactatttgaagcattccataagccgtcacgattcagatgatttataataataagaggaaatttatcatagaacaataaggtgcatagatagagtgttaatatatcataacatcctttgtttattcatagaagaagtgagatggagctcagttattatactgttacatggtcggatacaatattccatgctctccatgagctcttacacctacatgcattttagttcatacttgcggccgctcattcagggacagcagccagctgggcaatctcgcctaagaagctgaccaatttctgaaccccggggatgatggctggggccctgtagggcaggttgtgcttggcgcacaacttctgcacctccagggaagctgccgtgaggttgtgcctgggcatgttgggccacaagtggtgctcaatctggtagttgagaccaccaaagacccaatcggtgagaaggccgggcttaatgttcaacgtctcgtggatctggctggcgctgaacccgtgctcatcccagacagtctcctcaaccttgtccaaaggatagtgattcagaaacacaacgatggcaatgccaaatcctccgagcagctcggagatcaagaagcatcccaaaccggtggcaaagctaggcatggcactgcaatagaaagtggccttgagcacccagtggagggccagaccaatcgcctccttagtgtactggcgcttgtagtacaggttcctctcctcgctcttgtaggacatgacgccgccgatggattggaggcaccagatgaacctaagggatgcaatggtgggaatgaagtagtactgctggtacttgatgagattccgagtcgaaggagtagccctcttgacatcttcgggagaccaagccaggatggggaggttatcaatatctgggtcatggccgaccacattggtggcggcatggtgaccattgtgcctatccttccaccaagtctgtgagtatccctgcatcacgttaccgaaaaagagaccgaaagcgtcgttaatcttgcggtttgtgaaaacctggtgatggcaatagtcgtgggacaaccagcctagctgttggtagcacacgccaagaaccaaagcagcggtgaaataccaattcgtgtacacggtcatcaagatggaaaggaccatcaaaccgacggtagttgaagtcttgtaaaaataccaaaggaaactcgtctcgaacatacccttggagatgaattcctcccgcaacttgcggaaatcctcctggggctcatcacgcttaggcttgggtgcaacaggtgtgtcaggagaggaaggctccataacaggcattctcttcaacttggcgacggcttcttgagagtgcatcaccatgaagacatcggtcgcatcgcggttgcgatagttctcgataatgtcagctcctccagggtggtgattgacccaagcagacacatcataagttgcgccatcaattgtgattggcagagcttgccgcttaggagacatggtgcggccgcagtatatcttaaattctttaatacggtgtactaggatattgaactggttcttgatgatgaaaacctgggccgagattgcagctatttatagtcataggtcttgttaacatgcatggacatttggccacggggtggcatgcagtttgacgggtgttgaaataaacaaaaatgaggtggcggaagagaatacgagtttgaggttgggttagaaacaacaaatgtgagggctcatgatgggttgagttggtgaatgttttgggctgctcgattgacacctttgtgagtacgtgttgttgtgcatggcttttggggtccagtttttttttcttgacgcggcgatcctgatcagctagtggataagtgatgtccactgtgtgtgattgcgtttttgtttgaattttatgaacttagacattgctatgcaaaggatactctcattgtgttttgtcttcttttgttccttggctttttcttatgatccaagagactagtcagtgttgtggcattcgagactaccaagattaattatgatgggggaaggataagtaactgattagtacggactgttaccaaattaattaataagcggcaaatgaagggcatggatcctgcaggtcgactcgacgtacgatcccacatgcaagtttttatttcaatcccttttcctttgaataactgaccaagaacaacaagaaaaaaaaaaaaaaagaaaaggatcattttgaaaggatatttttcgctcctattcaaatactgtatttttaccaaaaaaactgtatttttcctacactctcaagctttgtttttcgcttcgactctcatgatttccttcatatgccaatcactctatttataaatggcataaggtagtgtgaacaattgcaaagcttgtcatcaaaagcttgcaatgtacaaattaatgtttttcatgcctttcaaaattatctgcaccccctagctattaatctaacatctaagtaaggctagtgaattttttcgaatagtcatgcagtgcattaatttccccgtgactattttggctttgactccaacactggccccgtacatccgtccctcattacatgaaaagaaatattgtttatattcttaattaaaaatattgtcccttctaaattttcatatagttaattattatattacttttttctctattctattagttctattttcaaattattatttatgcatatgtaaagtacattatatttttgctatatacttaaatatttctaaattattaaaaaaagactgatatgaaaaatttattctttttaaagctatatcattttatatatactttttcttttcttttctttcattttctattcaatttaataagaaataaattttgtaaatttttatttatcaatttataaaaatattttactttatatgttttttcacatttttgttaaacaaatcatatcattatgattgaaagagaggaaattgacagtgagtaataagtgatgagaaaaaaatgtgttatttcctaaaaaaaacctaaacaaacatgtatctactctctatttcatctatctctcatttcatttttctctttatctctttctttatttttttatcatatcatttcacattaattatttttactctctttattttttctctctatccctctcttatttccactcatatatacactccaaaattggggcatgcctttatcactactctatctcctccactaaatcatttaaatgaaactgaaaagcattggcaagtctcctcccctcctcaagtgatttccaactcagcattggcatctaattgattcagtatatctattgcatgtgtaaaagtctttccacaatacataactattaattaatcttaaataaataaaggataaaatatttttttttcttcataaaattaaaatatgttattttttgtttagatgtatattcgaataaatctaaatatatgataatgattttttatattgattaaacatataatcaatattaaatatgatatttttttatataggttgtacacataattttataaggataaaaaatatgataaaaataaattttaaatatttttatatttacgagaaaaaaaaatattttagccataaataaatgaccagcatattttacaaccttagtaattcataaattcctatatgtatatttgaaattaaaaacagataatcgttaagggaaggaatcctacgtcatctcttgccatttgtttttcatgcaaacagaaagggacgaaaaaccacctcaccatgaatcactcttcacaccatttttactagcaaacaagtctcaacaactgaagccagctctctttccgtttctttttacaacactttctttgaaatagtagtatttttttttcacatgatttattaacgtgccaaaagatgcttattgaatagagtgcacatttgtaatgtactactaattagaacatgaaaaagcattgttctaacacgataatcctgtgaaggcgttaactccaaagatccaatttcactatataaattgtgacgaaagcaaaatgaattcacatagctgagagagaaaggaaaggttaactaagaagcaatacttcagcggccgcgttaaagacacaaagcctttagcctatgctgccaataatggataccaacaaaagggttcttcttttgattttgatcctagcgctcctccaccgtttaagattgcagaaatcagagcttcaataccaaaacattgctgggtcaagaatccatggagatccctcagttatgttctcagggatgtgcttgtaattgctgcattggtggctgcagcaattcacttcgacaactggcttctctggctaatctattgccccattcaaggcacaatgttctgggctctctttgttcttggacatgattgtggccatggaagcttttcagatagccctttgctgaatagcctggtgggacacatcttgcattcctcaattcttgtgccataccatggatggagaattagccacagaactcaccatcaaaaccatggacacattgagaaggatgagtcatgggttccattaacagagaagatttacaagaatctagacagcatgacaagactcattagattcactgtgccatttccattgtttgtgtatccaatttatttgttttcaagaagccccggaaaggaaggctctcacttcaatccctacagcaatctgttcccacccagtgagagaaaaggaatagcaatatcaacactgtgttgggctaccatgttttctctgcttatctatctccttccatggccacaatcatgtccaagaacaaagagagcccagaacattgtgccttgaatggggcaatagattagccagagaagccagttgtcgaagtgaattgctgcagccaccaatgcagcaattacaagcacatccctgagaacataactgagggatctccatggattcttgacccagcaatgttttggtattgaagctctgatttctgcaatcttaaacggtggaggagcgctaggatcaaaatcaaaagaagaacccttttgttggtatccattattggcagcataggctaaaggctttgtgtctttaaccctgcaggtacc

SEQ ID NO: 27 - DNA, 9103 bp, Artificial Sequence
  palsmid BC-ELfad3_ALS
gtacgtctagaggatccgtcgacggcgcgcccgatcatccggatatagttcctcctttcagcaaaaaacccctcaagacccgtttagaggccccaaggggttatgctagttattgctcagcggtggcagcagccaactcagcttcctttcgggctttgttagcagccggatcgatccaagctgtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggcttttccatgggtatatctccttcttaaagttaaacaaaattatttctagagggaaaccgttgtggtctccctatagtgagtcgtattaatttcgcgggatcgagatctgatcaacctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatggacatattgtcgttagaacgcggctacaattaatacataaccttatgtatcatacacatacgatttaggtgacactatagaacggcgcgccaagctgggtctagaactagaaacgtgatgccacttgttattgaagtcgattacagcatctattctgttttactatttataactttgccatttctgacttttgaaaactatctctggatttcggtatcgctttgtgaagatcgagcaaaagagacgttttgtggacgcaatggtccaaatccgttctacatgaacaaattggtcacaatttccactaaaagtaaataaatggcaagttaaaaaaggaatatgcattttactgattgcctaggtgagctccaagagaagttgaatctacacgtctaccaaccgctaaaaaaagaaaaacattgatatgtaacctgattccattagcttttgacttcttcaacagattctctacttagatttctaacagaaatattattactagcacatcattttcagtctcactacagcaaaaaatccaacggcacaatacagacaacaggagatatcagactacagagatagatagatgctactgcatgtagtaagttaaataaaaggaaaataaaatgtcttgctaccaaaactactacagactatgatgctcaccacaggccaaatcctgcaactaggacagcattatcttatatatattgtacaaaacaagcatcaaggaacatttggtctaggcaatcagtacctcgttctaccatcaccctcagttatcacatccttgaaggatccattactgggaatcatcggcaacacatgctcctgatggggcacaatgacatcaagaaggtaggggccaggggtgtccaacattctctgaattgccgctctaagctcttccttcttcgtcactcgcgctgccggtatcccacaagcatcagcaaacttgagcatgtttgggaatatctcgctctcgctagacggatctccaagataggtgtgagctctattggacttgtagaacctatcctccaactgaaccaccatacccaaatgctgattgttcaacaacaatatcttaactgggagattctccactcttatagtggccaactcctgaacattcatgatgaaactaccatccccatcaatgtcaaccacaacagccccagggttagcaacagcagcaccaatagccgcaggcaatccaaaacccatggctccaagaccccctgaggtcaaccactgcctcggtctcttgtacttgtaaaactgcgcagcccacatttgatgctgcccaaccccagtactaacaatagcatctccattagtcaactcatcaagaacctcgatagcatgctgcggagaaatcgcgtcctggaatgtcttgtaacccaatggaaacttgtgtttctgcacattaatctcttctctccaacctccaagatcaaacttaccctccactcctttctcctccaaaatcatattaattcccttcaaggccaacttcaaatccgcgcaaaccgacacgtgcgcctgcttgttcttcccaatctcggcagaatcaatatcaatgtgaacaatcttagccctactagcaaaagcctcaagcttcccagtaacacggtcatcaaaccttaccccaaaggcaagcaacaaatcactattgtcaacagcatagttagcataaacagtaccatgcatacccagcatctgaagggaatattcatcaccaataggaaaagttccaagacccattaaagtgctagcaacgggaataccagtgagttcaacaaagcgcctcaattcagcactggaattcaaactgccaccgccgacgtagagaacgggcttttgggcctccatgatgagtctgacaatgtgttccaattgggcctcggcggggggcctgggcagcctggcgaggtaaccggggaggttaacgggctcgtcccaattaggcacggcgagttgctgctgaacgtctttgggaatgtcgatgaggaccggaccggggcggccggaggtggcgacgaagaaagcctcggcgacgacgcgggggatgtcgtcgacgtcgaggatgaggtagttgtgcttcgtgatggatctgctcacctccacgatcggggtttcttggaaggcgtcggtgccgatcatccggcgggcgacctggccggtgatggcgacgactgggacgctgtccattaaagcgtcggcgaggccgctcacgaggttggtggcgccggggccggaggtggcaatgcagacgccggggaggccggaggaacgcgcgtagccttcggcggcgaagacgccgccctgctcgtggcgcgggagcacgttgcggatggcggcggagcgcgtgagcgcctggtggatctccatcgacgcaccgccggggtacgcgaacaccgtcgtcacgccctgcctctccagcgcctccacaaggatgtccgcgcccttgcgaggttcgccggaggcgaaccgtgacacgaagggctccgtggtcggcgcttccttggtgaagggcgccgccgtggggggtttggagatggaacatttgattttgagagcgtggttgggtttggtgagggtttgatgagagagagggagggtggatctagtaatgcgtttggggaaggtggggtgtgaagaggaagaagagaatcgggtggttctggaagcggtggccgccattgtgttgtgtggcatggttatacttcaaaaactgcacaacaagcctagagttagtacctaaacagtaaatttacaacagagagcaaagacacatgcaaaaatttcagccataaaaaaagttataatagaatttaaagcaaaagtttcattttttaaacatatatacaaacaaactggatttgaaggaagggattaattcccctgctcaaagtttgaattcctattgtgacctatactcgaataaaattgaagcctaaggaatgtatgagaaacaagaaaacaaaacaaaactacagacaaacaagtacaattacaaaattcgctaaaattctgtaatcaccaaaccccatctcagtcagcacaaggcccaaggtttattttgaaataaaaaaaaagtgattttatttctcataagctaaaagaaagaaaggcaattatgaaatgatttcgactagatctgaaagtccaacgcgtattccgcagatattaaagaaagagtagagtttcacatggatcctagatggacccagttgaggaaaaagcaaggcaaagcaaaccagaagtgcaagatccgaaattgaaccacggaatctaggatttggtagagggagaagaaaagtaccttgagaggtagaagagaagagaagagcagagagatatatgaacgagtgtgtcttggtctcaactctgaagcgatacgagtttagaggggagcattgagttccaatttatagggaaaccgggtggcaggggtgagttaatgacggaaaagcccctaagtaacgagattggattgtgggttagattcaaccgtttgcatccgcggcttagattggggaagtcagagtgaatctcaaccgttgactgagttgaaaattgaatgtagcaaccaattgagccaaccccagcctttgccctttgattttgatttgtttgttgcatactttttatttgtcttctggttctgactctctttctctcgtttcaatgccaggttgcctactcccacaccactcacaagaagattctactgttagtattaaatattttttaatgtattaaatgatgaatgcttttgtaaacagaacaagactatgtctaataagtgtcttgcaacattttttaagaaattaaaaaaaatatatttattatcaaaatcaaatgtatgaaaaatcatgaataatataattttatacatttttttaaaaaatcttttaatttcttaattaatatcttaaaaataatgattaatatttaacccaaaataattagtatgattggtaaggaagatatccatgttatgtttggatgtgagtttgatctagagcaaagcttactagagtcgacctgcaggttgaaacatccctgaagtgtctcattttattttatttattctttgctgataaaaaaataaaataaaagaagctaagcacacggtcaaccattgctctactgctaaaagggttatgtgtagtgttttactgcataaattatgcagcaaacaagacaactcaaattaaaaaatttcctttgcttgtttttttgttgtctctgacttgactttcttgtggaagttggttgtataaggattgggacaccattgtccttcttaatttaattttattctttgctgataaaaaaaaaaatttcatatagtgttaaataataatttgttaaataaccaaaaagtcaaatatgtttactctcgtttaaataattgagattcgtccagcaaggctaaacgattgtatagatttatgacaatatttacttttttatagataaatgttatattataataaatttatatacatatattatatgttatttattattattttaaatccttcaatattttatcaaaccaactcataattttttttttatctgtaagaagcaataaaattaaatagacccactttaaggatgatccaacctttatacagagtaagagagttcaaatagtaccctttcatatacatatcaactaaaatattagaaatatcatggatcaaaccttataaagacattaaataagtggataagtataatatataaatgggtagtatataatatataaatggatacaaacttctctctttataattgttatgtctccttaacatcctaatataatacataagtgggtaatatataatatataaatggagacaaacttcttccattataattgttatgtcttcttaacacttatgtctcgttcacaatgctaaggttagaattgtttagaaagtcttatagtacacatttgtttttgtactatttgaagcattccataagccgtcacgattcagatgatttataataataagaggaaatttatcatagaacaataaggtgcatagatagagtgttaatatatcataacatcctttgtttattcatagaagaagtgagatggagctcagttattatactgttacatggtcggatacaatattccatgctctccatgagctcttacacctacatgcattttagttcatacttgcggccgcagctggtcatctcgctcatcgtcgagtcggcggccggagctggtcatctcgctcatcgtcgagtcggcggccaattccatagagcttgagcactagaagtggactagttatgaatgagagatagataagcagagaaaacatggtagcccaacacagtgttgatattgctattccttttctctcactgggtgggaacagattgctgtagggattgaagtgagagccttcctttccggggcttcttgaaaacaaataaattggatacacaaacaatggaaatggcacagtgaatctaatgagtcttgtcatgctgtctagattcttgtaaatcttctctgttaatggaacccatgactcatccttctcaatgtgtccatggttttgatggtgagttctgtggctaattctccatccatggtatggcacaagaattgaggaatgcaagatgtgtcccaccaggctattcagcaaagggctatctgaaaagcttccatggccacaatcatgtccaagaacaaagagagcccagaacattgtgccttgaatggggcaatagattagccagagaagccagttgtcgaagtgaattgctgcagccaccaatgcagcaattacaagcacatccctgagaacataactgagggatctccatggattcttgacccagcaatgttttggtattgaagctctgatttctgcaatcttaaacggtggaggagggccgccgactcgacgatgagcgagatgaccagctccggccgccgactcgacgatgagcgagatgaccagctgcggccgcagtatatcttaaattctttaatacggtgtactaggatattgaactggttcttgatgatgaaaacctgggccgagattgcagctatttatagtcataggtcttgttaacatgcatggacatttggccacggggtggcatgcagtttgacgggtgttgaaataaacaaaaatgaggtggcggaagagaatacgagtttgaggttgggttagaaacaacaaatgtgagggctcatgatgggttgagttggtgaatgttttgggctgctcgattgacacctttgtgagtacgtgttgttgtgcatggcttttggggtccagtttttttttcttgacgcggcgatcctgatcagctagtggataagtgatgtccactgtgtgtgattgcgtttttgtttgaattttatgaacttagacattgctatgcaaaggatactctcattgtgttttgtcttcttttgttccttggctttttcttatgatccaagagactagtcagtgttgtggcattcgagactaccaagattaattatgatgggggaaggataagtaactgattagtacggactgttaccaaattaattaataagcggcaaatgaagggcatggatcctgcaggtcgactcgac

SEQ ID NO: 28 - DNA, 5705 bp, Artificial Sequence
  plasmid BC-ELfad3_ALS
ggccgcatgagccgtaaaggttcaatacaacgagtgcttgttttcttagggacaagcattgtacttatgtatgattctgtgtaaccatgagtcttccacgttgtactaatgtgaagggcaaaaataaaacacagaacaagttcgtttttctcaaataatgtgaaggtagaaaatggaaccatgcctcctctcttgcatgtgatttaaaatattagcagatggtaccgtacgtgggcggatcccccgggctgcaggaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttgcatgcctgcaggtcgactcgacgtacgatcccacatgcaagtttttatttcaatcccttttcctttgaataactgaccaagaacaacaagaaaaaaaaaaaaaaagaaaaggatcattttgaaaggatatttttcgctcctattcaaatactgtatttttaccaaaaaaactgtatttttcctacactctcaagctttgtttttcgcttcgactctcatgatttccttcatatgccaatcactctatttataaatggcataaggtagtgtgaacaattgcaaagcttgtcatcaaaagcttgcaatgtacaaattaatgtttttcatgcctttcaaaattatctgcaccccctagctattaatctaacatctaagtaaggctagtgaattttttcgaatagtcatgcagtgcattaatttccccgtgactattttggctttgactccaacactggccccgtacatccgtccctcattacatgaaaagaaatattgtttatattcttaattaaaaatattgtcccttctaaattttcatatagttaattattatattacttttttctctattctattagttctattttcaaattattatttatgcatatgtaaagtacattatatttttgctatatacttaaatatttctaaattattaaaaaaagactgatatgaaaaatttattctttttaaagctatatcattttatatatactttttcttttcttttctttcattttctattcaatttaataagaaataaattttgtaaatttttatttatcaatttataaaaatattttactttatatgttttttcacatttttgttaaacaaatcatatcattatgattgaaagagaggaaattgacagtgagtaataagtgatgagaaaaaaatgtgttatttcctaaaaaaaacctaaacaaacatgtatctactctctatttcatctatctctcatttcatttttctctttatctctttctttatttttttatcatatcatttcacattaattatttttactctctttattttttctctctatccctctcttatttccactcatatatacactccaaaattggggcatgcctttatcactactctatctcctccactaaatcatttaaatgaaactgaaaagcattggcaagtctcctcccctcctcaagtgatttccaactcagcattggcatctaattgattcagtatatctattgcatgtgtaaaagtctttccacaatacataactattaattaatcttaaataaataaaggataaaatatttttttttcttcataaaattaaaatatgttattttttgtttagatgtatattcgaataaatctaaatatatgataatgattttttatattgattaaacatataatcaatattaaatatgatatttttttatataggttgtacacataattttataaggataaaaaatatgataaaaataaattttaaatatttttatatttacgagaaaaaaaaatattttagccataaataaatgaccagcatattttacaaccttagtaattcataaattcctatatgtatatttgaaattaaaaacagataatcgttaagggaaggaatcctacgtcatctcttgccatttgtttttcatgcaaacagaaagggacgaaaaaccacctcaccatgaatcactcttcacaccatttttactagcaaacaagtctcaacaactgaagccagctctctttccgtttctttttacaacactttctttgaaatagtagtatttttttttcacatgatttattaacgtgccaaaagatgcttattgaatagagtgcacatttgtaatgtactactaattagaacatgaaaaagcattgttctaacacgataatcctgtgaaggcgttaactccaaagatccaatttcactatataaattgtgacgaaagcaaaatgaattcacatagctgagagagaaaggaaaggttaactaagaagcaatacttcagcggccgcagctggtcatctcgctcatcgtcgagtcggcggccggagctggtcatctcgctcatcgtcgagtcggcggccctcctccaccgtttaagattgcagaaatcagagcttcaataccaaaacattgctgggtcaagaatccatggagatccctcagttatgttctcagggatgtgcttgtaattgctgcattggtggctgcagcaattcacttcgacaactggcttctctggctaatctattgccccattcaaggcacaatgttctgggctctctttgttcttggacatgattgtggccatggaagcttttcagatagccctttgctgaatagcctggtgggacacatcttgcattcctcaattcttgtgccataccatggatggagaattagccacagaactcaccatcaaaaccatggacacattgagaaggatgagtcatgggttccattaacagagaagatttacaagaatctagacagcatgacaagactcattagattcactgtgccatttccattgtttgtgtatccaatttatttgttttcaagaagccccggaaaggaaggctctcacttcaatccctacagcaatctgttcccacccagtgagagaaaaggaatagcaatatcaacactgtgttgggctaccatgttttctctgcttatctatctctcattcataactagtccacttctagtgctcaagctctatggaattggccgccgactcgacgatgagcgagatgaccagctccggccgccgactcgacgatgagcgagatgaccagctgc

SEQ ID NO: 29 - DNA, 12591 bp, Artificial Sequence
  plasmid BC-Tpom_Ann-ELfad3_ALS
gtacgtctagaggatccgtcgacggcgcgcccgatcatccggatatagttcctcctttcagcaaaaaacccctcaagacccgtttagaggccccaaggggttatgctagttattgctcagcggtggcagcagccaactcagcttcctttcgggctttgttagcagccggatcgatccaagctgtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggcttttccatgggtatatctccttcttaaagttaaacaaaattatttctagagggaaaccgttgtggtctccctatagtgagtcgtattaatttcgcgggatcgagatctgatcaacctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatggacatattgtcgttagaacgcggctacaattaatacataaccttatgtatcatacacatacgatttaggtgacactatagaacggcgcgccaagctgggtctagaactagaaacgtgatgccacttgttattgaagtcgattacagcatctattctgttttactatttataactttgccatttctgacttttgaaaactatctctggatttcggtatcgctttgtgaagatcgagcaaaagagacgttttgtggacgcaatggtccaaatccgttctacatgaacaaattggtcacaatttccactaaaagtaaataaatggcaagttaaaaaaggaatatgcattttactgattgcctaggtgagctccaagagaagttgaatctacacgtctaccaaccgctaaaaaaagaaaaacattgatatgtaacctgattccattagcttttgacttcttcaacagattctctacttagatttctaacagaaatattattactagcacatcattttcagtctcactacagcaaaaaatccaacggcacaatacagacaacaggagatatcagactacagagatagatagatgctactgcatgtagtaagttaaataaaaggaaaataaaatgtcttgctaccaaaactactacagactatgatgctcaccacaggccaaatcctgcaactaggacagcattatcttatatatattgtacaaaacaagcatcaaggaacatttggtctaggcaatcagtacctcgttctaccatcaccctcagttatcacatccttgaaggatccattactgggaatcatcggcaacacatgctcctgatggggcacaatgacatcaagaaggtaggggccaggggtgtccaacattctctgaattgccgctctaagctcttccttcttcgtcactcgcgctgccggtatcccacaagcatcagcaaacttgagcatgtttgggaatatctcgctctcgctagacggatctccaagataggtgtgagctctattggacttgtagaacctatcctccaactgaaccaccatacccaaatgctgattgttcaacaacaatatcttaactgggagattctccactcttatagtggccaactcctgaacattcatgatgaaactaccatccccatcaatgtcaaccacaacagccccagggttagcaacagcagcaccaatagccgcaggcaatccaaaacccatggctccaagaccccctgaggtcaaccactgcctcggtctcttgtacttgtaaaactgcgcagcccacatttgatgctgcccaaccccagtactaacaatagcatctccattagtcaactcatcaagaacctcgatagcatgctgcggagaaatcgcgtcctggaatgtcttgtaacccaatggaaacttgtgtttctgcacattaatctcttctctccaacctccaagatcaaacttaccctccactcctttctcctccaaaatcatattaattcccttcaaggccaacttcaaatccgcgcaaaccgacacgtgcgcctgcttgttcttcccaatctcggcagaatcaatatcaatgtgaacaatcttagccctactagcaaaagcctcaagcttcccagtaacacggtcatcaaaccttaccccaaaggcaagcaacaaatcactattgtcaacagcatagttagcataaacagtaccatgcatacccagcatctgaagggaatattcatcaccaataggaaaagttccaagacccattaaagtgctagcaacgggaataccagtgagttcaacaaagcgcctcaattcagcactggaattcaaactgccaccgccgacgtagagaacgggcttttgggcctccatgatgagtctgacaatgtgttccaattgggcctcggcggggggcctgggcagcctggcgaggtaaccggggaggttaacgggctcgtcccaattaggcacggcgagttgctgctgaacgtctttgggaatgtcgatgaggaccggaccggggcggccggaggtggcgacgaagaaagcctcggcgacgacgcgggggatgtcgtcgacgtcgaggatgaggtagttgtgcttcgtgatggatctgctcacctccacgatcggggtttcttggaaggcgtcggtgccgatcatccggcgggcgacctggccggtgatggcgacgactgggacgctgtccattaaagcgtcggcgaggccgctcacgaggttggtggcgccggggccggaggtggcaatgcagacgccggggaggccggaggaacgcgcgtagccttcggcggcgaagacgccgccctgctcgtggcgcgggagcacgttgcggatggcggcggagcgcgtgagcgcctggtggatctccatcgacgcaccgccggggtacgcgaacaccgtcgtcacgccctgcctctccagcgcctccacaaggatgtccgcgcccttgcgaggttcgccggaggcgaaccgtgacacgaagggctccgtggtcggcgcttccttggtgaagggcgccgccgtggggggtttggagatggaacatttgattttgagagcgtggttgggtttggtgagggtttgatgagagagagggagggtggatctagtaatgcgtttggggaaggtggggtgtgaagaggaagaagagaatcgggtggttctggaagcggtggccgccattgtgttgtgtggcatggttatacttcaaaaactgcacaacaagcctagagttagtacctaaacagtaaatttacaacagagagcaaagacacatgcaaaaatttcagccataaaaaaagttataatagaatttaaagcaaaagtttcattttttaaacatatatacaaacaaactggatttgaaggaagggattaattcccctgctcaaagtttgaattcctattgtgacctatactcgaataaaattgaagcctaaggaatgtatgagaaacaagaaaacaaaacaaaactacagacaaacaagtacaattacaaaattcgctaaaattctgtaatcaccaaaccccatctcagtcagcacaaggcccaaggtttattttgaaataaaaaaaaagtgattttatttctcataagctaaaagaaagaaaggcaattatgaaatgatttcgactagatctgaaagtccaacgcgtattccgcagatattaaagaaagagtagagtttcacatggatcctagatggacccagttgaggaaaaagcaaggcaaagcaaaccagaagtgcaagatccgaaattgaaccacggaatctaggatttggtagagggagaagaaaagtaccttgagaggtagaagagaagagaagagcagagagatatatgaacgagtgtgtcttggtctcaactctgaagcgatacgagtttagaggggagcattgagttccaatttatagggaaaccgggtggcaggggtgagttaatgacggaaaagcccctaagtaacgagattggattgtgggttagattcaaccgtttgcatccgcggcttagattggggaagtcagagtgaatctcaaccgttgactgagttgaaaattgaatgtagcaaccaattgagccaaccccagcctttgccctttgattttgatttgtttgttgcatactttttatttgtcttctggttctgactctctttctctcgtttcaatgccaggttgcctactcccacaccactcacaagaagattctactgttagtattaaatattttttaatgtattaaatgatgaatgcttttgtaaacagaacaagactatgtctaataagtgtcttgcaacattttttaagaaattaaaaaaaatatatttattatcaaaatcaaatgtatgaaaaatcatgaataatataattttatacatttttttaaaaaatcttttaatttcttaattaatatcttaaaaataatgattaatatttaacccaaaataattagtatgattggtaaggaagatatccatgttatgtttggatgtgagtttgatctagagcaaagcttactagagtcgacctgcaggttgaaacatccctgaagtgtctcattttattttatttattctttgctgataaaaaaataaaataaaagaagctaagcacacggtcaaccattgctctactgctaaaagggttatgtgtagtgttttactgcataaattatgcagcaaacaagacaactcaaattaaaaaatttcctttgcttgtttttttgttgtctctgacttgactttcttgtggaagttggttgtataaggattgggacaccattgtccttcttaatttaattttattctttgctgataaaaaaaaaaatttcatatagtgttaaataataatttgttaaataaccaaaaagtcaaatatgtttactctcgtttaaataattgagattcgtccagcaaggctaaacgattgtatagatttatgacaatatttacttttttatagataaatgttatattataataaatttatatacatatattatatgttatttattattattttaaatccttcaatattttatcaaaccaactcataattttttttttatctgtaagaagcaataaaattaaatagacccactttaaggatgatccaacctttatacagagtaagagagttcaaatagtaccctttcatatacatatcaactaaaatattagaaatatcatggatcaaaccttataaagacattaaataagtggataagtataatatataaatgggtagtatataatatataaatggatacaaacttctctctttataattgttatgtctccttaacatcctaatataatacataagtgggtaatatataatatataaatggagacaaacttcttccattataattgttatgtcttcttaacacttatgtctcgttcacaatgctaaggttagaattgtttagaaagtcttatagtacacatttgtttttgtactatttgaagcattccataagccgtcacgattcagatgatttataataataagaggaaatttatcatagaacaataaggtgcatagatagagtgttaatatatcataacatcctttgtttattcatagaagaagtgagatggagctcagttattatactgttacatggtcggatacaatattccatgctctccatgagctcttacacctacatgcattttagttcatacttgcggccgctcattcagggacagcagccagctgggcaatctcgcctaagaagctgaccaatttctgaaccccggggatgatggctggggccctgtagggcaggttgtgcttggcgcacaacttctgcacctccagggaagctgccgtgaggttgtgcctgggcatgttgggccacaagtggtgctcaatctggtagttgagaccaccaaagacccaatcggtgagaaggccgggcttaatgttcaacgtctcgtggatctggctggcgctgaacccgtgctcatcccagacagtctcctcaaccttgtccaaaggatagtgattcagaaacacaacgatggcaatgccaaatcctccgagcagctcggagatcaagaagcatcccaaaccggtggcaaagctaggcatggcactgcaatagaaagtggccttgagcacccagtggagggccagaccaatcgcctccttagtgtactggcgcttgtagtacaggttcctctcctcgctcttgtaggacatgacgccgccgatggattggaggcaccagatgaacctaagggatgcaatggtgggaatgaagtagtactgctggtacttgatgagattccgagtcgaaggagtagccctcttgacatcttcgggagaccaagccaggatggggaggttatcaatatctgggtcatggccgaccacattggtggcggcatggtgaccattgtgcctatccttccaccaagtctgtgagtatccctgcatcacgttaccgaaaaagagaccgaaagcgtcgttaatcttgcggtttgtgaaaacctggtgatggcaatagtcgtgggacaaccagcctagctgttggtagcacacgccaagaaccaaagcagcggtgaaataccaattcgtgtacacggtcatcaagatggaaaggaccatcaaaccgacggtagttgaagtcttgtaaaaataccaaaggaaactcgtctcgaacatacccttggagatgaattcctcccgcaacttgcggaaatcctcctggggctcatcacgcttaggcttgggtgcaacaggtgtgtcaggagaggaaggctccataacaggcattctcttcaacttggcgacggcttcttgagagtgcatcaccatgaagacatcggtcgcatcgcggttgcgatagttctcgataatgtcagctcctccagggtggtgattgacccaagcagacacatcataagttgcgccatcaattgtgattggcagagcttgccgcttaggagacatggtgcggccgcagtatatcttaaattctttaatacggtgtactaggatattgaactggttcttgatgatgaaaacctgggccgagattgcagctatttatagtcataggtcttgttaacatgcatggacatttggccacggggtggcatgcagtttgacgggtgttgaaataaacaaaaatgaggtggcggaagagaatacgagtttgaggttgggttagaaacaacaaatgtgagggctcatgatgggttgagttggtgaatgttttgggctgctcgattgacacctttgtgagtacgtgttgttgtgcatggcttttggggtccagtttttttttcttgacgcggcgatcctgatcagctagtggataagtgatgtccactgtgtgtgattgcgtttttgtttgaattttatgaacttagacattgctatgcaaaggatactctcattgtgttttgtcttcttttgttccttggctttttcttatgatccaagagactagtcagtgttgtggcattcgagactaccaagattaattatgatgggggaaggataagtaactgattagtacggactgttaccaaattaattaataagcggcaaatgaagggcatggatcctgcaggtcgactcgacgtacgatcccacatgcaagtttttatttcaatcccttttcctttgaataactgaccaagaacaacaagaaaaaaaaaaaaaaagaaaaggatcattttgaaaggatatttttcgctcctattcaaatactgtatttttaccaaaaaaactgtatttttcctacactctcaagctttgtttttcgcttcgactctcatgatttccttcatatgccaatcactctatttataaatggcataaggtagtgtgaacaattgcaaagcttgtcatcaaaagcttgcaatgtacaaattaatgtttttcatgcctttcaaaattatctgcaccccctagctattaatctaacatctaagtaaggctagtgaattttttcgaatagtcatgcagtgcattaatttccccgtgactattttggctttgactccaacactggccccgtacatccgtccctcattacatgaaaagaaatattgtttatattcttaattaaaaatattgtcccttctaaattttcatatagttaattattatattacttttttctctattctattagttctattttcaaattattatttatgcatatgtaaagtacattatatttttgctatatacttaaatatttctaaattattaaaaaaagactgatatgaaaaatttattctttttaaagctatatcattttatatatactttttcttttcttttctttcattttctattcaatttaataagaaataaattttgtaaatttttatttatcaatttataaaaatattttactttatatgttttttcacatttttgttaaacaaatcatatcattatgattgaaagagaggaaattgacagtgagtaataagtgatgagaaaaaaatgtgttatttcctaaaaaaaacctaaacaaacatgtatctactctctatttcatctatctctcatttcatttttctctttatctctttctttatttttttatcatatcatttcacattaattatttttactctctttattttttctctctatccctctcttatttccactcatatatacactccaaaattggggcatgcctttatcactactctatctcctccactaaatcatttaaatgaaactgaaaagcattggcaagtctcctcccctcctcaagtgatttccaactcagcattggcatctaattgattcagtatatctattgcatgtgtaaaagtctttccacaatacataactattaattaatcttaaataaataaaggataaaatatttttttttcttcataaaattaaaatatgttattttttgtttagatgtatattcgaataaatctaaatatatgataatgattttttatattgattaaacatataatcaatattaaatatgatatttttttatataggttgtacacataattttataaggataaaaaatatgataaaaataaattttaaatatttttatatttacgagaaaaaaaaatattttagccataaataaatgaccagcatattttacaaccttagtaattcataaattcctatatgtatatttgaaattaaaaacagataatcgttaagggaaggaatcctacgtcatctcttgccatttgtttttcatgcaaacagaaagggacgaaaaaccacctcaccatgaatcactcttcacaccatttttactagcaaacaagtctcaacaactgaagccagctctctttccgtttctttttacaacactttctttgaaatagtagtatttttttttcacatgatttattaacgtgccaaaagatgcttattgaatagagtgcacatttgtaatgtactactaattagaacatgaaaaagcattgttctaacacgataatcctgtgaaggcgttaactccaaagatccaatttcactatataaattgtgacgaaagcaaaatgaattcacatagctgagagagaaaggaaaggttaactaagaagcaatacttcagcggccgcagctggtcatctcgctcatcgtcgagtcggcggccggagctggtcatctcgctcatcgtcgagtcggcggccctcctccaccgtttaagattgcagaaatcagagcttcaataccaaaacattgctgggtcaagaatccatggagatccctcagttatgttctcagggatgtgcttgtaattgctgcattggtggctgcagcaattcacttcgacaactggcttctctggctaatctattgccccattcaaggcacaatgttctgggctctctttgttcttggacatgattgtggccatggaagcttttcagatagccctttgctgaatagcctggtgggacacatcttgcattcctcaattcttgtgccataccatggatggagaattagccacagaactcaccatcaaaaccatggacacattgagaaggatgagtcatgggttccattaacagagaagatttacaagaatctagacagcatgacaagactcattagattcactgtgccatttccattgtttgtgtatccaatttatttgttttcaagaagccccggaaaggaaggctctcacttcaatccctacagcaatctgttcccacccagtgagagaaaaggaatagcaatatcaacactgtgttgggctaccatgttttctctgcttatctatctctcattcataactagtccacttctagtgctcaagctctatggaattggccgccgactcgacgatgagcgagatgaccagctccggccgccgactcgacgatgagcgagatgaccagctgcggccgcatgagccgtaaaggttcaatacaacgagtgcttgttttcttagggacaagcattgtacttatgtatgattctgtgtaaccatgagtcttccacgttgtactaatgtgaagggcaaaaataaaacacagaacaagttcgtttttctcaaataatgtgaaggtagaaaatggaaccatgcctcctctcttgcatgtgatttaaaatattagcagatggtacc

SEQ ID NO: 30 - DNA, 32 bp, Artificial Sequence
  primer HPfad3-1
gcggccgcgttaaagacacaaagcctttagcc

SEQ ID NO: 31 - DNA, 34 bp, Artificial Sequence
  primer HPfad3-2
gattgtggccatggaaggagatagataagcagag

SEQ ID NO: 32 - DNA, 709 bp, Artificial Sequence
  fragment HPfad3AB
gcggccgcgttaaagacacaaagcctttagcctatgctgccaataatggataccaacaaaagggttcttcttttgattttgatcctagcgctcctccaccgtttaagattgcagaaatcagagcttcaataccaaaacattgctgggtcaagaatccatggagatccctcagttatgttctcagggatgtgcttgtaattgctgcattggtggctgcagcaattcacttcgacaactggcttctctggctaatctattgccccattcaaggcacaatgttctgggctctctttgttcttggacatgattgtggccatggaagcttttcagatagccctttgctgaatagcctggtgggacacatcttgcattcctcaattcttgtgccataccatggatggagaattagccacagaactcaccatcaaaaccatggacacattgagaaggatgagtcatgggttccattaacagagaagatttacaagaatctagacagcatgacaagactcattagattcactgtgccatttccattgtttgtgtatccaatttatttgttttcaagaagccccggaaaggaaggctctcacttcaatccctacagcaatctgttcccacccagtgagagaaaaggaatagcaatatcaacactgtgttgggctaccatgttttctctgcttatctatctccttccatggccacaatc

SEQ ID NO: 33 - DNA, 34 bp, Artificial Sequence
  primer HPfad3-3
ctctgcttatctatctccttccatggccacaatc

SEQ ID NO: 34 - DNA, 36 bp, Artificial Sequence
  primer HPfad3-4
ggtacctgcagggttaaagacacaaagcctttagcc

SEQ ID NO: 35 - DNA, 343 bp, Artificial Sequence
  fragment HPfad3A'
ctctgcttatctatctccttccatggccacaatcatgtccaagaacaaagagagcccagaacattgtgccttgaatggggcaatagattagccagagaagccagttgtcgaagtgaattgctgcagccaccaatgcagcaattacaagcacatccctgagaacataactgagggatctccatggattcttgacccagcaatgttttggtattgaagctctgatttctgcaatcttaaacggtggaggagcgctaggatcaaaatcaaaagaagaacccttttgttggtatccattattggcagcataggctaaaggctttgtgtctttaaccctgcaggtacc

SEQ ID NO: 36 - DNA, 1018 bp, Artificial Sequence
  fragment HPfad3ABA'
gcggccgcgttaaagacacaaagcctttagcctatgctgccaataatggataccaacaaaagggttcttcttttgattttgatcctagcgctcctccaccgtttaagattgcagaaatcagagcttcaataccaaaacattgctgggtcaagaatccatggagatccctcagttatgttctcagggatgtgcttgtaattgctgcattggtggctgcagcaattcacttcgacaactggcttctctggctaatctattgccccattcaaggcacaatgttctgggctctctttgttcttggacatgattgtggccatggaagcttttcagatagccctttgctgaatagcctggtgggacacatcttgcattcctcaattcttgtgccataccatggatggagaattagccacagaactcaccatcaaaaccatggacacattgagaaggatgagtcatgggttccattaacagagaagatttacaagaatctagacagcatgacaagactcattagattcactgtgccatttccattgtttgtgtatccaatttatttgttttcaagaagccccggaaaggaaggctctcacttcaatccctacagcaatctgttcccacccagtgagagaaaaggaatagcaatatcaacactgtgttgggctaccatgttttctctgcttatctatctccttccatggccacaatcatgtccaagaacaaagagagcccagaacattgtgccttgaatggggcaatagattagccagagaagccagttgtcgaagtgaattgctgcagccaccaatgcagcaattacaagcacatccctgagaacataactgagggatctccatggattcttgacccagcaatgttttggtattgaagctctgatttctgcaatcttaaacggtggaggagcgctaggatcaaaatcaaaagaagaacccttttgttggtatccattattggcagcataggctaaaggctttgtgtctttaaccctgcaggtacc

SEQ ID NO: 37 - DNA, 4304 bp, Artificial Sequence
  plasmid BC-HPfad3ABA'
ctagacctgcaggatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcgttaaagacacaaagcctttagcctatgctgccaataatggataccaacaaaagggttcttcttttgattttgatcctagcgctcctccaccgtttaagattgcagaaatcagagcttcaataccaaaacattgctgggtcaagaatccatggagatccctcagttatgttctcagggatgtgcttgtaattgctgcattggtggctgcagcaattcacttcgacaactggcttctctggctaatctattgccccattcaaggcacaatgttctgggctctctttgttcttggacatgattgtggccatggaagcttttcagatagccctttgctgaatagcctggtgggacacatcttgcattcctcaattcttgtgccataccatggatggagaattagccacagaactcaccatcaaaaccatggacacattgagaaggatgagtcatgggttccattaacagagaagatttacaagaatctagacagcatgacaagactcattagattcactgtgccatttccattgtttgtgtatccaatttatttgttttcaagaagccccggaaaggaaggctctcacttcaatccctacagcaatctgttcccacccagtgagagaaaaggaatagcaatatcaacactgtgttgggctaccatgttttctctgcttatctatctccttccatggccacaatcatgtccaagaacaaagagagcccagaacattgtgccttgaatggggcaatagattagccagagaagccagttgtcgaagtgaattgctgcagccaccaatgcagcaattacaagcacatccctgagaacataactgagggatctccatggattcttgacccagcaatgttttggtattgaagctctgatttctgcaatcttaaacggtggaggagcgctaggatcaaaatcaaaagaagaacccttttgttggtatccattattggcagcataggctaaaggctttgtgtctttaaccctgcaggtaccgagctcgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttgcatgcctgcaggtcgact

SEQ ID NO: 38 - DNA, 5696 bp, Artificial Sequence
  plasmid Ann-HPfad3ABA'
ttgctgcagccaccaatgcagcaattacaagcacatccctgagaacataactgagggatctccatggattcttgacccagcaatgttttggtattgaagctctgatttctgcaatcttaaacggtggaggagcgctaggatcaaaatcaaaagaagaacccttttgttggtatccattattggcagcataggctaaaggctttgtgtctttaaccctgcaggtaccgtacgtgggcggatcccccgggctgcaggaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttgcatgcctgcaggtcgactcgacgtacgatcccacatgcaagtttttatttcaatcccttttcctttgaataactgaccaagaacaacaagaaaaaaaaaaaaaaagaaaaggatcattttgaaaggatatttttcgctcctattcaaatactgtatttttaccaaaaaaactgtatttttcctacactctcaagctttgtttttcgcttcgactctcatgatttccttcatatgccaatcactctatttataaatggcataaggtagtgtgaacaattgcaaagcttgtcatcaaaagcttgcaatgtacaaattaatgtttttcatgcctttcaaaattatctgcaccccctagctattaatctaacatctaagtaaggctagtgaattttttcgaatagtcatgcagtgcattaatttccccgtgactattttggctttgactccaacactggccccgtacatccgtccctcattacatgaaaagaaatattgtttatattcttaattaaaaatattgtcccttctaaattttcatatagttaattattatattacttttttctctattctattagttctattttcaaattattatttatgcatatgtaaagtacattatatttttgctatatacttaaatatttctaaattattaaaaaaagactgatatgaaaaatttattctttttaaagctatatcattttatatatactttttcttttcttttctttcattttctattcaatttaataagaaataaattttgtaaatttttatttatcaatttataaaaatattttactttatatgttttttcacatttttgttaaacaaatcatatcattatgattgaaagagaggaaattgacagtgagtaataagtgatgagaaaaaaatgtgttatttcctaaaaaaaacctaaacaaacatgtatctactctctatttcatctatctctcatttcatttttctctttatctctttctttatttttttatcatatcatttcacattaattatttttactctctttattttttctctctatccctctcttatttccactcatatatacactccaaaattggggcatgcctttatcactactctatctcctccactaaatcatttaaatgaaactgaaaagcattggcaagtctcctcccctcctcaagtgatttccaactcagcattggcatctaattgattcagtatatctattgcatgtgtaaaagtctttccacaatacataactattaattaatcttaaataaataaaggataaaatatttttttttcttcataaaattaaaatatgttattttttgtttagatgtatattcgaataaatctaaatatatgataatgattttttatattgattaaacatataatcaatattaaatatgatatttttttatataggttgtacacataattttataaggataaaaaatatgataaaaataaattttaaatatttttatatttacgagaaaaaaaaatattttagccataaataaatgaccagcatattttacaaccttagtaattcataaattcctatatgtatatttgaaattaaaaacagataatcgttaagggaaggaatcctacgtcatctcttgccatttgtttttcatgcaaacagaaagggacgaaaaaccacctcaccatgaatcactcttcacaccatttttactagcaaacaagtctcaacaactgaagccagctctctttccgtttctttttacaacactttctttgaaatagtagtatttttttttcacatgatttattaacgtgccaaaagatgcttattgaatagagtgcacatttgtaatgtactactaattagaacatgaaaaagcattgttctaacacgataatcctgtgaaggcgttaactccaaagatccaatttcactatataaattgtgacgaaagcaaaatgaattcacatagctgagagagaaaggaaaggttaactaagaagcaatacttcagcggccgcgttaaagacacaaagcctttagcctatgctgccaataatggataccaacaaaagggttcttcttttgattttgatcctagcgctcctccaccgtttaagattgcagaaatcagagcttcaataccaaaacattgctgggtcaagaatccatggagatccctcagttatgttctcagggatgtgcttgtaattgctgcattggtggctgcagcaattcacttcgacaactggcttctctggctaatctattgccccattcaaggcacaatgttctgggctctctttgttcttggacatgattgtggccatggaagcttttcagatagccctttgctgaatagcctggtgggacacatcttgcattcctcaattcttgtgccataccatggatggagaattagccacagaactcaccatcaaaaccatggacacattgagaaggatgagtcatgggttccattaacagagaagatttacaagaatctagacagcatgacaagactcattagattcactgtgccatttccattgtttgtgtatccaatttatttgttttcaagaagccccggaaaggaaggctctcacttcaatccctacagcaatctgttcccacccagtgagagaaaaggaatagcaatatcaacactgtgttgggctaccatgttttctctgcttatctatctccttccatggccacaatcatgtccaagaacaaagagagcccagaacattgtgccttgaatggggcaatagattagccagagaagccagttgtcgaagtgaa

SEQ ID NO: 39 - DNA, 8145 bp, Artificial Sequence
  plasmid HPfad3ABA'_ALS
gtacgtctagaggatccgtcgacggcgcgcccgatcatccggatatagttcctcctttcagcaaaaaacccctcaagacccgtttagaggccccaaggggttatgctagttattgctcagcggtggcagcagccaactcagcttcctttcgggctttgttagcagccggatcgatccaagctgtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggcttttccatgggtatatctccttcttaaagttaaacaaaattatttctagagggaaaccgttgtggtctccctatagtgagtcgtattaatttcgcgggatcgagatctgatcaacctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatggacatattgtcgttagaacgcggctacaattaatacataaccttatgtatcatacacatacgatttaggtgacactatagaacggcgcgccaagctgggtctagaactagaaacgtgatgccacttgttattgaagtcgattacagcatctattctgttttactatttataactttgccatttctgacttttgaaaactatctctggatttcggtatcgctttgtgaagatcgagcaaaagagacgttttgtggacgcaatggtccaaatccgttctacatgaacaaattggtcacaatttccactaaaagtaaataaatggcaagttaaaaaaggaatatgcattttactgattgcctaggtgagctccaagagaagttgaatctacacgtctaccaaccgctaaaaaaagaaaaacattgatatgtaacctgattccattagcttttgacttcttcaacagattctctacttagatttctaacagaaatattattactagcacatcattttcagtctcactacagcaaaaaatccaacggcacaatacagacaacaggagatatcagactacagagatagatagatgctactgcatgtagtaagttaaataaaaggaaaataaaatgtcttgctaccaaaactactacagactatgatgctcaccacaggccaaatcctgcaactaggacagcattatcttatatatattgtacaaaacaagcatcaaggaacatttggtctaggcaatcagtacctcgttctaccatcaccctcagttatcacatccttgaaggatccattactgggaatcatcggcaacacatgctcctgatggggcacaatgacatcaagaaggtaggggccaggggtgtccaacattctctgaattgccgctctaagctcttccttcttcgtcactcgcgctgccggtatcccacaagcatcagcaaacttgagcatgtttgggaatatctcgctctcgctagacggatctccaagataggtgtgagctctattggacttgtagaacctatcctccaactgaaccaccatacccaaatgctgattgttcaacaacaatatcttaactgggagattctccactcttatagtggccaactcctgaacattcatgatgaaactaccatccccatcaatgtcaaccacaacagccccagggttagcaacagcagcaccaatagccgcaggcaatccaaaacccatggctccaagaccccctgaggtcaaccactgcctcggtctcttgtacttgtaaaactgcgcagcccacatttgatgctgcccaaccccagtactaacaatagcatctccattagtcaactcatcaagaacctcgatagcatgctgcggagaaatcgcgtcctggaatgtcttgtaacccaatggaaacttgtgtttctgcacattaatctcttctctccaacctccaagatcaaacttaccctccactcctttctcctccaaaatcatattaattcccttcaaggccaacttcaaatccgcgcaaaccgacacgtgcgcctgcttgttcttcccaatctcggcagaatcaatatcaatgtgaacaatcttagccctactagcaaaagcctcaagcttcccagtaacacggtcatcaaaccttaccccaaaggcaagcaacaaatcactattgtcaacagcatagttagcataaacagtaccatgcatacccagcatctgaagggaatattcatcaccaataggaaaagttccaagacccattaaagtgctagcaacgggaataccagtgagttcaacaaagcgcctcaattcagcactggaattcaaactgccaccgccgacgtagagaacgggcttttgggcctccatgatgagtctgacaatgtgttccaattgggcctcggcggggggcctgggcagcctggcgaggtaaccggggaggttaacgggctcgtcccaattaggcacggcgagttgctgctgaacgtctttgggaatgtcgatgaggaccggaccggggcggccggaggtggcgacgaagaaagcctcggcgacgacgcgggggatgtcgtcgacgtcgaggatgaggtagttgtgcttcgtgatggatctgctcacctccacgatcggggtttcttggaaggcgtcggtgccgatcatccggcgggcgacctggccggtgatggcgacgactgggacgctgtccattaaagcgtcggcgaggccgctcacgaggttggtggcgccggggccggaggtggcaatgcagacgccggggaggccggaggaacgcgcgtagccttcggcggcgaagacgccgccctgctcgtggcgcgggagcacgttgcggatggcggcggagcgcgtgagcgcctggtggatctccatcgacgcaccgccggggtacgcgaacaccgtcgtcacgccctgcctctccagcgcctccacaaggatgtccgcgcccttgcgaggttcgccggaggcgaaccgtgacacgaagggctccgtggtcggcgcttccttggtgaagggcgccgccgtggggggtttggagatggaacatttgattttgagagcgtggttgggtttggtgagggtttgatgagagagagggagggtggatctagtaatgcgtttggggaaggtggggtgtgaagaggaagaagagaatcgggtggttctggaagcggtggccgccattgtgttgtgtggcatggttatacttcaaaaactgcacaacaagcctagagttagtacctaaacagtaaatttacaacagagagcaaagacacatgcaaaaatttcagccataaaaaaagttataatagaatttaaagcaaaagtttcattttttaaacatatatacaaacaaactggatttgaaggaagggattaattcccctgctcaaagtttgaattcctattgtgacctatactcgaataaaattgaagcctaaggaatgtatgagaaacaagaaaacaaaacaaaactacagacaaacaagtacaattacaaaattcgctaaaattctgtaatcaccaaaccccatctcagtcagcacaaggcccaaggtttattttgaaataaaaaaaaagtgattttatttctcataagctaaaagaaagaaaggcaattatgaaatgatttcgactagatctgaaagtccaacgcgtattccgcagatattaaagaaagagtagagtttcacatggatcctagatggacccagttgaggaaaaagcaaggcaaagcaaaccagaagtgcaagatccgaaattgaaccacggaatctaggatttggtagagggagaagaaaagtaccttgagaggtagaagagaagagaagagcagagagatatatgaacgagtgtgtcttggtctcaactctgaagcgatacgagtttagaggggagcattgagttccaatttatagggaaaccgggtggcaggggtgagttaatgacggaaaagcccctaagtaacgagattggattgtgggttagattcaaccgtttgcatccgcggcttagattggggaagtcagagtgaatctcaaccgttgactgagttgaaaattgaatgtagcaaccaattgagccaaccccagcctttgccctttgattttgatttgtttgttgcatactttttatttgtcttctggttctgactctctttctctcgtttcaatgccaggttgcctactcccacaccactcacaagaagattctactgttagtattaaatattttttaatgtattaaatgatgaatgcttttgtaaacagaacaagactatgtctaataagtgtcttgcaacattttttaagaaattaaaaaaaatatatttattatcaaaatcaaatgtatgaaaaatcatgaataatataattttatacatttttttaaaaaatcttttaatttcttaattaatatcttaaaaataatgattaatatttaacccaaaataattagtatgattggtaaggaagatatccatgttatgtttggatgtgagtttgatctagagcaaagcttactagagtcgacctgcagggttaaagacacaaagcctttagcctatgctgccaataatggataccaacaaaagggttcttcttttgattttgatcctagcgctcctccaccgtttaagattgcagaaatcagagcttcaataccaaaacattgctgggtcaagaatccatggagatccctcagttatgttctcagggatgtgcttgtaattgctgcattggtggctgcagcaattcacttcgacaactggcttctctggctaatctattgccccattcaaggcacaatgttctgggctctctttgttcttggacatgattgtggccatggaaggagatagataagcagagaaaacatggtagcccaacacagtgttgatattgctattccttttctctcactgggtgggaacagattgctgtagggattgaagtgagagccttcctttccggggcttcttgaaaacaaataaattggatacacaaacaatggaaatggcacagtgaatctaatgagtcttgtcatgctgtctagattcttgtaaatcttctctgttaatggaacccatgactcatccttctcaatgtgtccatggttttgatggtgagttctgtggctaattctccatccatggtatggcacaagaattgaggaatgcaagatgtgtcccaccaggctattcagcaaagggctatctgaaaagcttccatggccacaatcatgtccaagaacaaagagagcccagaacattgtgccttgaatggggcaatagattagccagagaagccagttgtcgaagtgaattgctgcagccaccaatgcagcaattacaagcacatccctgagaacataactgagggatctccatggattcttgacccagcaatgttttggtattgaagctctgatttctgcaatcttaaacggtggaggagcgctaggatcaaaatcaaaagaagaacccttttgttggtatccattattggcagcataggctaaaggctttgtgtctttaacgcggccgcagtatatcttaaattctttaatacggtgtactaggatattgaactggttcttgatgatgaaaacctgggccgagattgcagctatttatagtcataggtcttgttaacatgcatggacatttggccacggggtggcatgcagtttgacgggtgttgaaataaacaaaaatgaggtggcggaagagaatacgagtttgaggttgggttagaaacaacaaatgtgagggctcatgatgggttgagttggtgaatgttttgggctgctcgattgacacctttgtgagtacgtgttgttgtgcatggcttttggggtccagtttttttttcttgacgcggcgatcctgatcagctagtggataagtgatgtccactgtgtgtgattgcgtttttgtttgaattttatgaacttagacattgctatgcaaaggatactctcattgtgttttgtcttcttttgttccttggctttttcttatgatccaagagactagtcagtgttgtggcattcgagactaccaagattaattatgatgggggaaggataagtaactgattagtacggactgttaccaaattaattaataagcggcaaatgaagggcatggatcctgcaggtcgactcgac

SEQ ID NO: 40 - DNA, 11781 bp, Artificial Sequence
  plasmid pKKE2
  misc_feature (1180)..(1180): n is a, c, g, or t
gtacgtcctcgaagagaagggttaataacacattttttaacatttttaacacaaattttagttatttaaaaatttattaaaaaatttaaaataagaagaggaactctttaaataaatctaacttacaaaatttatgatttttaataagttttcaccaataaaaaatgtcataaaaatatgttaaaaagtatattatcaatattctctttatgataaataaaaagaaaaaaaaaataaaagttaagtgaaaatgagattgaagtgactttaggtgtgtataaatatatcaaccccgccaacaatttatttaatccaaatatattgaagtatattattccatagcctttatttatttatatatttattatataaaagctttatttgttctaggttgttcatgaaatatttttttggttttatctccgttgtaagaaaatcatgtgctttgtgtcgccactcactattgcagctttttcatgcattggtcagattgacggttgattgtatttttgttttttatggttttgtgttatgacttaagtcttcatctctttatctcttcatcaggtttgatggttacctaatatggtccatgggtacatgcatggttaaattaggtggccaactttgttgtgaacgatagaattttttttatattaagtaaactatttttatattatgaaataataataaaaaaaatattttatcattattaacaaaatcatattagttaatttgttaactctataataaaagaaatactgtaacattcacattacatggtaacatctttccaccctttcatttgttttttgtttgatgactttttttcttgtttaaatttatttcccttcttttaaatttggaatacattatcatcatatataaactaaaatactaaaaacaggattacacaaatgataaataataacacaaatatttataaatctagctgcaatatatttaaactagctatatcgatattgtaaaataaaactagctgcattgatactgataaaaaaatatcatgtgctttctggactgatgatgcagtatacttttgacattgcctttattttatttttcagaaaagctttcttagttctgggttcttcattatttgtttcccatctccattgtgaattgaatcatttgcttcgtgtcacaaatacaatttagntaggtacatgcattggtcagattcacggtttattatgtcatgacttaagttcatggtagtacattacctgccacgcatgcattatattggttagatttgataggcaaatttggttgtcaacaatataaatataaataatgtttttatattacgaaataacagtgatcaaaacaaacagttttatctttattaacaagattttgtttttgtttgatgacgttttttaatgtttacgctttcccccttcttttgaatttagaacactttatcatcataaaatcaaatactaaaaaaattacatatttcataaataataacacaaatatttttaaaaaatctgaaataataatgaacaatattacatattatcacgaaaattcattaataaaaatattatataaataaaatgtaatagtagttatatgtaggaaaaaagtactgcacgcataatatatacaaaaagattaaaatgaactattataaataataacactaaattaatggtgaatcatatcaaaataatgaaaaagtaaataaaatttgtaattaacttctatatgtattacacacacaaataataaataatagtaaaaaaaattatgataaatatttaccatctcataagatatttaaaataatgataaaaatatagattattttttatgcaactagctagccaaaaagagaacacgggtatatataaaaagagtacctttaaattctactgtacttcctttattcctgacgtttttatatcaagtggacatacgtgaagattttaattatcagtctaaatatttcattagcacttaatacttttctgttttattcctatcctataagtagtcccgattctcccaacattgcttattcacacaactaactaagaaagtcttccatagccccccaagcggccgcatgggaacggaccaaggaaaaaccttcacctgggaagagctggcggcccataacaccaaggacgacctactcttggccatccgcggcagggtgtacgatgtcacaaagttcttgagccgccatcctggtggagtggacactctcctgctcggagctggccgagatgttactccggtctttgagatgtatcacgcgtttggggctgcagatgccattatgaagaagtactatgtcggtacactggtctcgaatgagctgcccatcttcccggagccaacggtgttccacaaaaccatcaagacgagagtcgagggctactttacggatcggaacattgatcccaagaatagaccagagatctggggacgatacgctcttatctttggatccttgatcgcttcctactacgcgcagctctttgtgcctttcgttgtcgaacgcacatggcttcaggtggtgtttgcaatcatcatgggatttgcgtgcgcacaagtcggactcaaccctcttcatgatgcgtctcacttttcagtgacccacaaccccactgtctggaagattctgggagccacgcacgactttttcaacggagcatcgtacctggtgtggatgtaccaacatatgctcggccatcacccctacaccaacattgctggagcagatcccgacgtgtcgacgtctgagcccgatgttcgtcgtatcaagcccaaccaaaagtggtttgtcaaccacatcaaccagcacatgtttgttcctttcctgtacggactgctggcgttcaaggtgcgcattcaggacatcaacattttgtactttgtcaagaccaatgacgctattcgtgtcaatcccatctcgacatggcacactgtgatgttctggggcggcaaggctttctttgtctggtatcgcctgattgttcccctgcagtatctgcccctgggcaaggtgctgctcttgttcacggtcgcggacatggtgtcgtcttactggctggcgctgaccttccaggcgaaccacgttgttgaggaagttcagtggccgttgcctgacgagaacgggatcatccaaaaggactgggcagctatgcaggtcgagactacgcaggattacgcacacgattcgcacctctggaccagcatcactggcagcttgaactaccaggctgtgcaccatctgttccccaacgtgtcgcagcaccattatcccgatattctggccatcatcaagaacacctgcagcgagtacaaggttccataccttgtcaaggatacgttttggcaagcatttgcttcacatttggagcacttgcgtgttcttggactccgtcccaaggaagagtaggcggccgcgacacaagtgtgagagtactaaataaatgctttggttgtacgaaatcattacactaaataaaataatcaaagcttatatatgccttccgctaaggccgaatgcaaagaaattggttctttctcgttatcttttgccacttttactagtacgtattaattactacttaatcatctttgtttacggctcattatatccgtacggatccgtcgacggcgcgcccgatcatccggatatagttcctcctttcagcaaaaaacccctcaagacccgtttagaggccccaaggggttatgctagttattgctcagcggtggcagcagccaactcagcttcctttcgggctttgttagcagccggatcgatccaagctgtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggcttttccatgggtatatctccttcttaaagttaaacaaaattatttctagagggaaaccgttgtggtctccctatagtgagtcgtattaatttcgcgggatcgagatctgatcaacctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatggacatattgtcgttagaacgcggctacaattaatacataaccttatgtatcatacacatacgatttaggtgacactatagaacggcgcgccaagcttgttgaaacatccctgaagtgtctcattttattttatttattctttgctgataaaaaaataaaataaaagaagctaagcacacggtcaaccattgctctactgctaaaagggttatgtgtagtgttttactgcataaattatgcagcaaacaagacaactcaaattaaaaaatttcctttgcttgtttttttgttgtctctgacttgactttcttgtggaagttggttgtataaggattgggacaccattgtccttcttaatttaattttattctttgctgataaaaaaaaaaatttcatatagtgttaaataataatttgttaaataaccaaaaagtcaaatatgtttactctcgtttaaataattgagattcgtccagcaaggctaaacgattgtatagatttatgacaatatttacttttttatagataaatgttatattataataaatttatatacatatattatatgttatttattattattttaaatccttcaatattttatcaaaccaactcataattttttttttatctgtaagaagcaataaaattaaatagacccactttaaggatgatccaacctttatacagagtaagagagttcaaatagtaccctttcatatacatatcaactaaaatattagaaatatcatggatcaaaccttataaagacattaaataagtggataagtataatatataaatgggtagtatataatatataaatggatacaaacttctctctttataattgttatgtctccttaacatcctaatataatacataagtgggtaatatataatatataaatggagacaaacttcttccattataattgttatgtcttcttaacacttatgtctcgttcacaatgctaaggttagaattgtttagaaagtcttatagtacacatttgtttttgtactatttgaagcattccataagccgtcacgattcagatgatttataataataagaggaaatttatcatagaacaataaggtgcatagatagagtgttaatatatcataacatcctttgtttattcatagaagaagtgagatggagctcagttattatactgttacatggtcggatacaatattccatgctctccatgagctcttacacctacatgcattttagttcatacttgcggccagcttttacatggcgggaaactccttgaagaactcgatcgagatgcgctcgaggtgcacgacgacctcggccatgcccgcgatgaagcccgtctcgtggtatgggatgtcgtactgcttgcagagcgacttgacgagcacgttgagcgccgggaggttgtgccggggcaccatcgggaacaagtggtggtcgatctggtagttgaggccgcccatgaaccagtcgatccagagcgacgacgtcacgttgcgcgtcgagagcacttgcagcttccaaaaatcgggcttgctgtccttgtcaaagacctccatgccgttgtggccgacgctaaagaccatcgcgaggaagaggccgcacgacgcctggctcacaaagaggaacgcagccgcttggagcagcgacatgttggctgcgtacacaaggccgaggttccagccgtagtagaggaggaggccggcgcgctcgagcagcgggtactggaccttgtcaaaggtgccgccgggcccaacgttgtagaaggcgtacatggccgactggatcacccacgagatacgcgcaaagagcaagatgggaaagtacaggtacgcttggtagcgcatgaagaagagcccgacgggcgagtcgaccgcgtgctgcgccatcttgagcgaccacgcgagaatcggcatcgtgtcaatgtccgggtcgccgtggaaggcgatctcgggcgtcgcgtggaggttggggatcgcatggtgcgtgttgtgcttgttcttccaccactgcaccgagaagccctgccagaggttgccgaccatgacgccgacgaggtcgccaaacaagtggttctcaaacacttggtggtgcagaaagtcatgggcgagccagccgcactgctggtaaaagaggccaaggatgacagccgcgaccatgtacatggccgtcgagtcaaagtggaggcaaatggccgccgacacaagcgcaatgctcagcgtcgaggcgcacttgtagaggtagtagagcttgctcgagtcgtacaagccgaggcgcttgacttcaaggcgcagcttgcggtacgacgcaatgaagtccgactggctcttcttgacctcgtccgagatcgacgtgtcgacggccgccgtcgactggtcgacgtcgccgacgtagtactgctcgaggagcttgagcgccgagctcgggtggaagacagcgaacgcatcggtcgcgtcttcgccggcctgcgtgaacatgacgacgccgcccgggtggtcctcaaaggccgagatgtcgtacaccttgtggtggatcacgatccacgcgttgtcttggcggttgtgctcacggatggtcgcccacgagatcttctcggccttttgcccctggaccatgaattggccgcagtatatcttaaattctttaatacggtgtactaggatattgaactggttcttgatgatgaaaacctgggccgagattgcagctatttatagtcataggtcttgttaacatgcatggacatttggccacggggtggcatgcagtttgacgggtgttgaaataaacaaaaatgaggtggcggaagagaatacgagtttgaggttgggttagaaacaacaaatgtgagggctcatgatgggttgagttggtgaatgttttgggctgctcgattgacacctttgtgagtacgtgttgttgtgcatggcttttggggtccagtttttttttcttgacgcggcgatcctgatcagctagtggataagtgatgtccactgtgtgtgattgcgtttttgtttgaattttatgaacttagacattgctatgcaaaggatactctcattgtgttttgtcttcttttgttccttggctttttcttatgatccaagagactagtcagtgttgtggcattcgagactaccaagattaattatgatgggggaaggataagtaactgattagtacggactgttaccaaattaattaataagcggcaaatgaagggcatggatcaaaagcttggatctcctgcaggctagcctaagtacgtactcaaaatgccaacaaataaaaaaaaagttgctttaataatgccaaaacaaattaataaaacacttacaacaccggattttttttaattaaaatgtgccatttaggataaatagttaatatttttaataattatttaaaaagccgtatctactaaaatgatttttatttggttgaaaatattaatatgtttaaatcaacacaatctatcaaaattaaactaaaaaaaaaataagtgtacgtggttaacattagtacagtaatataagaggaaaatgagaaattaagaaattgaaagcgagtctaatttttaaattatgaacctgcatatataaaaggaaagaaagaatccaggaagaaaagaaatgaaaccatgcatggtcccctcgtcatcacgagtttctgccatttgcaatagaaacactgaaacacctttctctttgtcacttaattgagatgccgaagccacctcacaccatgaacttcatgaggtgtagcacccaaggcttccatagccatgcatactgaagaatgtctcaagctcagcaccctacttctgtgacgtgtccctcattcaccttcctctcttccctataaataaccacgcctcaggttctccgcttcacaactcaaacattctctccattggtccttaaacactcatcagtcatcaccgcggccgcatggagtcgattgcgccattcctcccatcaaagatgccgcaagatctgtttatggaccttgccaccgctatcggtgtccgggccgcgccctatgtcgatcctctcgaggccgcgctggtggcccaggccgagaagtacatccccacgattgtccatcacacgcgtgggttcctggtcgcggtggagtcgcctttggcccgtgagctgccgttgatgaacccgttccacgtgctgttgatcgtgctcgcttatttggtcacggtctttgtgggcatgcagatcatgaagaactttgagcggttcgaggtcaagacgttttcgctcctgcacaacttttgtctggtctcgatcagcgcctacatgtgcggtgggatcctgtacgaggcttatcaggccaactatggactgtttgagaacgctgctgatcataccttcaagggtcttcctatggccaagatgatctggctcttctacttctccaagatcatggagtttgtcgacaccatgatcatggtcctcaagaagaacaaccgccagatctccttcttgcacgtttaccaccacagctccatcttcaccatctggtggttggtcacctttgttgcacccaacggtgaagcctacttctctgctgcgttgaactcgttcatccatgtgatcatgtacggctactacttcttgtcggccttgggcttcaagcaggtgtcgttcatcaagttctacatcacgcgctcgcagatgacacagttctgcatgatgtcggtccagtcttcctgggacatgtacgccatgaaggtccttggccgccccggataccccttcttcatcacggctctgctttggttctacatgtggaccatgctcggtctcttctacaacttttacagaaagaacgccaagttggccaagcaggccaaggccgacgctgccaaggagaaggcaaggaagttgcagtaagcggccgcatttcgcaccaaatcaatgaaagtaataatgaaaagtctgaataagaatacttaggcttagatgcctttgttacttgtgtaaaataacttgagtcatgtacctttggcggaaacagaataaataaaaggtgaaattccaatgctctatgtataagttagtaatacttaatgtgttctacggttgtttcaatatcatcaaactctaattgaaactttagaaccacaaatctcaatcttttcttaatgaaatgaaaaatcttaattgtaccatgtttatgttaaacaccttacaattggttggagaggaggaccaaccgatgggacaacattgggagaaagagattcaatggagatttggataggagaacaacattctttttcacttcaatacaagatgagtgcaacactaaggatatgtatgagactttcagaagctacgacaacatagatgagtgaggtggtgattcctagcaagaaagacattagaggaagccaaaatcgaacaaggaagacatcaagggcaagagacaggaccatccatctcaggaaaaggagctttgggatagtccgagaagttgtacaagaaattttttggagggtgagtgatgcattgctggtgactttaactcaatcaaaattgagaaagaaagaaaagggagggggctcacatgtgaatagaagggaaacgggagaattttacagttttgatctaatgggcatcccagctagtggtaacatattcaccatgtttaaccttcac

SEQ ID NO: 41 - DNA, 11366 bp, Artificial Sequence
  plasmid pKR973
  misc_feature (5237)..(5237): n is a, c, g, or t
ggagatccaagcttggcgcgccgttctatagtgtcacctaaatcgtatgtgtatgatacataaggttatgtattaattgtagccgcgttctaacgacaatatgtccatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcaggttgatcagatctcgatcccgcgaaattaatacgactcactatagggagaccacaacggtttccctctagaaataattttgtttaactttaagaaggagatatacccatggaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacagcttggatcgatccggctgctaacaaagcccgaaaggaagctgagttggctgctgccaccgctgagcaataactagcataaccccttggggcctctaaacgggtcttgaggggttttttgctgaaaggaggaactatatccggatgatcgggcgcgccgtcgacggatccgtacccggggatcctctagacgtacgcaaaggcaaagatttaaactcgaaaacattacaaaagtctcaaaacagaggcaaggccatgcacaaagcacactctaagtgcttccattgcctactaagtagggtacgtacacgatcaccattcaccagtgatgatctttattaatatacaacacactcagagacagcttatgttatagctagctagcataaactatcacatcatgtgttagtacgacaagtgacaacattgcttttaacttcgcggccttggatcctctagaccggatataatgagccgtaaacaaagatgattaagtagtaattaatacgtactagtaaaagtggcaaaagataacgagaaagaaccaatttctttgcattcggccttagcggaaggcatatataagctttgattattttatttagtgtaatgatttcgtacaaccaaagcatttatttagtactctcacacttgtgtcgcggccgctcagtggaggaggtgctcgaaggcgagagccttgatgttctggtgcacgcactggaagaggttgccctcgcggtactcgaggccatgcttcttgaagaagtcgcgtacctcgggctggatagtcattaggttgccggtgggcatcatggggaagaggtgatgctcggtctgcagggagatgaagcccgtgagcacgttcactagccagccgcccgtgatgttacgggaggtcttggcggtctgctcgacgagcgtcatgccctcgacgtgctcgcggtcgaggatgtcctcaccatagtgggttgcaaagacaacgatgcccgtcgcgaagccgcgtgcaaccatcatgagagggatgaggttgagatgcgctgcgaagacccagcacaggagcgcgtagtgagcggcaagagcggcggcctgcatccacatcttaggcaggcgcacagccacgtacgcgatggactccaggcgccagtagaggtcgaggatggccatggtcggcacatagtagtactgctgccagcgctggaagaagttgagccgcttggcaatggacgggttctctcgcacgtagatgagcaggggcgccgtcttgatgtccgggtccgaaccatcctcgttggtgcacacgtggtgcgtgttatggcgcgcgcgccaccaggccacgtcgtagccctggaggaagccgagggcgtatcccatggcgttgttcgccttgacgagcgtgttgaccgagcccttgaagactgcgtgatgcaggtagtcgtgagcaagccagccgtcgaggtagaagccaaagcccatggagagcgcgcccgcgaggggcgagacgccgctccgcacgagataggcgcccacgaagatgggcgcaaggacgatggtgagcttgaacagctcgtccaacgggcaagggtcgtagagaccagccctcttgtggcgctcaatcatctccttgaactccgtgcccatggtggaccgcgagggcaggggcacggaagcgggcgcatcctccgacttcttgagcatgccctccatcatcttgatggccttgggcgagtggtaagactcgaactgctccgtcgcgtcgcgctcctggaagatgcggaacaccttgctcccgcccgggtgtgccttctggaactttgtgacatccacgcgcttgccgtagagcacgacgtgcacgctcttgctatcgacggagctcacctcagcgagagacgcgtcggtcccgctcaccgcctgcgcgccgccgtctccacccttgcccatggtgcggccgcttggggggctatggaagactttcttagttagttgtgtgaataagcaatgttgggagaatcgggactacttataggataggaataaaacagaaaagtattaagtgctaatgaaatatttagactgataattaaaatcttcacgtatgtccacttgatataaaaacgtcaggaataaaggaagtacagtagaatttaaaggtactctttttatatatacccgtgttctctttttggctagctagttgcataaaaaataatctatatttttatcattattttaaatatcttatgagatggtaaatatttatcataattttttttactattatttattatttgtgtgtgtaatacatatagaagttaattacaaattttatttactttttcattattttgatatgattcaccattaatttagtgttattatttataatagttcattttaatctttttgtatatattatgcgtgcagtacttttttcctacatataactactattacattttatttatataatatttttattaatgaattttcgtgataatatgtaatattgttcattattatttcagattttttaaaaatatttgtgttattatttatgaaatatgtaatttttttagtatttgattttatgatgataaagtgttctaaattcaaaagaagggggaaagcgtaaacattaaaaaacgtcatcaaacaaaaacaaaatcttgttaataaagataaaactgtttgttttgatcactgttatttcgtaatataaaaacattatttatatttatattgttgacaaccaaatttgcctatcaaatctaaccaatataatgcatgcgtggcaggtaatgtactaccatgaacttaagtcatgacataataaaccgtgaatctgaccaatgcatgtacctanctaaattgtatttgtgacacgaagcaaatgattcaattcacaatggagatgggaaacaaataatgaagaacccagaactaagaaagcttttctgaaaaataaaataaaggcaatgtcaaaagtatactgcatcatcagtccagaaagcacatgatatttttttatcagtatcaatgcagctagttttattttacaatatcgatatagctagtttaaatatattgcagctagatttataaatatttgtgttattatttatcatttgtgtaatcctgtttttagtattttagtttatatatgatgataatgtattccaaatttaaaagaagggaaataaatttaaacaagaaaaaaagtcatcaaacaaaaaacaaatgaaagggtggaaagatgttaccatgtaatgtgaatgttacagtatttcttttattatagagttaacaaattaactaatatgattttgttaataatgataaaatattttttttattattatttcataatataaaaatagtttacttaatataaaaaaaattctatcgttcacaacaaagttggccacctaatttaaccatgcatgtacccatggaccatattaggtaaccatcaaacctgatgaagagataaagagatgaagacttaagtcataacacaaaaccataaaaaacaaaaatacaatcaaccgtcaatctgaccaatgcatgaaaaagctgcaatagtgagtggcgacacaaagcacatgattttcttacaacggagataaaaccaaaaaaatatttcatgaacaacctagaacaaataaagcttttatataataaatatataaataaataaaggctatggaataatatacttcaatatatttggattaaataaattgttggcggggttgatatatttatacacacctaaagtcacttcaatctcattttcacttaacttttattttttttttctttttatttatcataaagagaatattgataatatactttttaacatatttttatgacattttttattggtgaaaacttattaaaaatcataaattttgtaagttagatttatttaaagagttcctcttcttattttaaattttttaataaatttttaaataactaaaatttgtgttaaaaatgttaaaaaatgtgttattaacccttctcttcgaggacgtacgaagcttagggcggatcccccgggcgacctcgagggggggcccggtacgtgaaggttaaacatggtgaatatgttaccactagctgggatgcccattagatcaaaactgtaaaattctcccgtttcccttctattcacatgtgagccccctcccttttctttctttctcaattttgattgagttaaagtcaccagcaatgcatcactcaccctccaaaaaatttcttgtacaacttctcggactatcccaaagctccttttcctgagatggatggtcctgtctcttgcccttgatgtcttccttgttcgattttggcttcctctaatgtctttcttgctaggaatcaccacctcactcatctatgttgtcgtagcttctgaaagtctcatacatatccttagtgttgcactcatcttgtattgaagtgaaaaagaatgttgttctcctatccaaatctccattgaatctctttctcccaatgttgtcccatcggttggtcctcctctccaaccaattgtaaggtgtttaacataaacatggtacaattaagatttttcatttcattaagaaaagattgagatttgtggttctaaagtttcaattagagtttgatgatattgaaacaaccgtagaacacattaagtattactaacttatacatagagcattggaatttcaccttttatttattctgtttccgccaaaggtacatgactcaagttattttacacaagtaacaaaggcatctaagcctaagtattcttattcagacttttcattattactttcattgatttggtgcgaaatgcggccgcctactcttccttgggacggagtccaagaacacgcaagtgctccaaatgtgaagcaaatgcttgccaaaacgtatccttgacaaggtatggaaccttgtactcgctgcaggtgttcttgatgatggccagaatatcgggataatggtgctgcgacacgttggggaacagatggtgcacagcctggtagttcaagctgccagtgatgctggtccagaggtgcgaatcgtgtgcgtaatcctgcgtagtctcgacctgcatagctgcccagtccttttggatgatcccgttctcgtcaggcaacggccactgaacttcctcaacaacgtggttcgcctggaaggtcagcgccagccagtaagacgacaccatgtccgcgaccgtgaacaagagcagcaccttgcccaggggcagatactgcaggggaacaatcaggcgataccagacaaagaaagccttgccgccccagaacatcacagtgtgccatgtcgagatgggattgacacgaatagcgtcattggtcttgacaaagtacaaaatgttgatgtcctgaatgcgcaccttgaacgccagcagtccgtacaggaaaggaacaaacatgtgctggttgatgtggttgacaaaccacttttggttgggcttgatacgacgaacatcgggctcagacgtcgacacgtcgggatctgctccagcaatgttggtgtaggggtgatggccgagcatatgttggtacatccacaccaggtacgatgctccgttgaaaaagtcgtgcgtggctcccagaatcttccagacagtggggttgtgggtcactgaaaagtgagacgcatcatgaagagggttgagtccgacttgtgcgcacgcaaatcccatgatgattgcaaacaccacctgaagccatgtgcgttcgacaacgaaaggcacaaagagctgcgcgtagtaggaagcgatcaaggatccaaagataagagcgtatcgtccccagatctctggtctattcttgggatcaatgttccgatccgtaaagtagccctcgactctcgtcttgatggttttgtggaacaccgttggctccgggaagatgggcagctcattcgagaccagtgtaccgacatagtacttcttcataatggcatctgcagccccaaacgcgtgatacatctcaaagaccggagtaacatctcggccagctccgagcaggagagtgtccactccaccaggatggcggctcaagaactttgtgacatcgtacaccctgccgcggatggccaagagtaggtcgtccttggtgttatgggccgccagctcttcccaggtgaaggtttttccttggtccgttcccatgcggccgcggtgatgactgatgagtgtttaaggaccaatggagagaatgtttgagttgtgaagcggagaacctgaggcgtggttatttatagggaagagaggaaggtgaatgagggacacgtcacagaagtagggtgctgagcttgagacattcttcagtatgcatggctatggaagccttgggtgctacacctcatgaagttcatggtgtgaggtggcttcggcatctcaattaagtgacaaagagaaaggtgtttcagtgtttctattgcaaatggcagaaactcgtgatgacgaggggaccatgcatggtttcatttcttttcttcctggattctttctttccttttatatatgcaggttcataatttaaaaattagactcgctttcaatttcttaatttctcattttcctcttatattactgtactaatgttaaccacgtacacttattttttttttagtttaattttgatagattgtgttgatttaaacatattaatattttcaaccaaataaaaatcattttagtagatacggctttttaaataattattaaaaatattaactatttatcctaaatggcacattttaattaaaaaaaatccggtgttgtaagtgttttattaatttgttttggcattattaaagcaactttttttttatttgttggcattttgagtacgtacttaggctagcctgcaggccaactgcgtttggggctccagattaaacgacgccgtttcgttcctttcgcttcacggcttaacgatgtcgtttctgtctgtgcccaaaaaataaaggcatttgttatttgcaccagatatttactaagtgcaccctagtttgacaagtaggcgataattacaaatagatgcggtgcaaataataaattttgaaggaaataattacaaaagaacagaacttatatttactttattttaaaaaactaaaatgaaagaacaaaaaaagtaaaaaatacaaaaaatgtgctttaaccactttcattatttgttacagaaagtatgattctactcaaattgatctgttgtatctggtgctgccttgtcacactggcgatttcaatcccctaaagatatggtgcaaactgcgaagtgatcaatatctgctcggttaatttagattaattaataatattcaacgtgatgtaccaaaaaaagacaattttttgctccattgacaaattaaacctcatcaaggtaatttccaaacctataagcaaaaaaatttcacattaattggcccgcaatcctattagtcttattatactagagtaggaaaaaaaacaattacacaacttgtcttattattctctatgctaatgaatatttttcccttttgttagaaatcagtgtttcctaatttattgagtattaattccactcaccgcatatatttaccgttgaataagaaaattttacacataattctttttaagataaataatttttttatactagatcttatatgattacgtgaagccaagtgggttatactaatgatatataatgtttgatagtaatcagtttataaaccaaatgcatggaaatgttacgtggaagcacgtaaattaacaagcattgaagcaaatgcagccaccgcaccaaaaccaccccacttcacttccacgtaccatattccatgcaactacaacaccctaaaacttcaataaatgcccccaccttcacttcacttcacccatcaatagcaagcggccgcaccatggaggtggtgaatgaaatagtctcaattgggcaggaagttttacccaaagttgattatgcccaactctggagtgatgccagtcactgtgaggtgctttacttgtccatcgcatttgtcatcttgaagttcactcttggcccccttggtccaaaaggtcagtctcgtatgaagtttgttttcaccaattacaaccttctcatgtccatttattcgttgggatcattcctctcaatggcatatgccatgtacaccatcggtgttatgtctgacaactgcgagaaggcttttgacaacaacgtcttcaggatcaccacgcagttgttctatttgagcaagttcctggagtatattgactccttctatttgccactgatgggcaagcctctgacctggttgcaattcttccatcatttgggggcaccgatggatatgtggctgttctataattaccgaaatgaagctgtttggatttttgtgctgttgaatggtttcatccactggatcatgtacggttattattggaccagattgatcaagctgaagttccccatgccaaaatccctgattacatcaatgcagatcattcaattcaatgttggtttctacattgtctggaagtacaggaacattccctgttatcgccaagatgggatgaggatgtttggctggttcttcaattacttttatgttggcacagtcttgtgtttgttcttgaatttctatgtgcaaacgtatatcgtcaggaagcacaagggagccaaaaagattcagtgagcggccgcgaagttaaaagcaatgttgtcacttgtcgtactaacacatgatgtgatagtttatgctagctagctataacataagctgtctctgagtgtgttgtatattaataaagatcatcactggtgaatggtgatcgtgtacgtaccctacttagtaggcaatggaagcacttagagtgtgctttgtgcatggccttgcctctgttttgagacttttgtaatgttttcgagtttaaatctttgcctttgcgtacgtctagagtcgacctgca

SEQ ID NO: 42 - DNA, 30 bp, Artificial Sequence
  primer oEugEL1-1
agcggccgcaccatggaggtggtgaatgaa

SEQ ID NO: 43 - DNA, 30 bp, Artificial Sequence
  primer oEugEL1-2
tgcggccgctcactgaatctttttggctcc

SEQ ID NO: 44 - DNA, 12947 bp, Artificial Sequence
  plasmid pKR1005
ggtcgactcgacgtacgtctagaggatccgtcgacggcgcgcccgatcatccggatatagttcctcctttcagcaaaaaacccctcaagacccgtttagaggccccaaggggttatgctagttattgctcagcggtggcagcagccaactcagcttcctttcgggctttgttagcagccggatcgatccaagctgtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggcttttccatgggtatatctccttcttaaagttaaacaaaattatttctagagggaaaccgttgtggtctccctatagtgagtcgtattaatttcgcgggatcgagatctgatcaacctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatggacatattgtcgttagaacgcggctacaattaatacataaccttatgtatcatacacatacgatttaggtgacactatagaacggcgcgccaagctgggtctagaactagaaacgtgatgccacttgttattgaagtcgattacagcatctattctgttttactatttataactttgccatttctgacttttgaaaactatctctggatttcggtatcgctttgtgaagatcgagcaaaagagacgttttgtggacgcaatggtccaaatccgttctacatgaacaaattggtcacaatttccactaaaagtaaataaatggcaagttaaaaaaggaatatgcattttactgattgcctaggtgagctccaagagaagttgaatctacacgtctaccaaccgctaaaaaaagaaaaacattgaatatgtaacctgattccattagcttttgacttcttcaacagattctctacttagatttctaacagaaatattattactagcacatcattttcagtctcactacagcaaaaaatccaacggcacaatacagacaacaggagatatcagactacagagatagatagatgctactgcatgtagtaagttaaataaaaggaaaataaaatgtcttgctaccaaaactactacagactatgatgctcaccacaggccaaatcctgcaactaggacagcattatcttatatatattgtacaaaacaagcatcaaggaacatttggtctaggcaatcagtacctcgttctaccatcaccctcagttatcacatccttgaaggatccattactgggaatcatcggcaacacatgctcctgatggggcacaatgacatcaagaaggtaggggccaggggtgtccaacattctctgaattgccgctctaagctcttccttcttcgtcactcgcgctgccggtatcccacaagcatcagcaaacttgagcatgtttgggaatatctcgctctcgctagacggatctccaagataggtgtgagctctattggacttgtagaacctatcctccaactgaaccaccatacccaaatgctgattgttcaacaacaatatcttaactgggagattctccactcttatagtggccaactcctgaacattcatgatgaaactaccatccccatcaatgtcaaccacaacagccccagggttagcaacagcagcaccaatagccgcaggcaatccaaaacccatggctccaagaccccctgaggtcaaccactgcctcggtctcttgtacttgtaaaactgcgcagcccacatttgatgctgcccaaccccagtactaacaatagcatctccattagtcaactcatcaagaacctcgatagcatgctgcggagaaatcgcgtcctggaatgtcttgtaacccaatggaaacttgtgtttctgcacattaatctcttctctccaacctccaagatcaaacttaccctccactcctttctcctccaaaatcatattaattcccttcaaggccaacttcaaatccgcgcaaaccgacacgtgcgcctgcttgttcttcccaatctcggcagaatcaatatcaatgtgaacaatcttagccctactagcaaaagcctcaagcttcccagtaacacggtcatcaaaccttaccccaaaggcaagcaacaaatcactattgtcaacagcatagttagcataaacagtaccatgcatacccagcatctgaagggaatattcatcaccaataggaaaagttccaagacccattaaagtgctagcaacgggaataccagtgagttcaacaaagcgcctcaattcagcactggaattcaaactgccaccgccgacgtagagaacgggcttttgggcctccatgatgagtctgacaatgtgttccaattgggcctcggcggggggcctgggcagcctggcgaggtaaccggggaggttaacgggctcgtcccaattaggcacggcgagttgctgctgaacgtctttgggaatgtcgatgaggaccggaccggggcggccggaggtggcgacgaagaaagcctcggcgacgacgcgggggatgtcgtcgacgtcgaggatgaggtagttgtgcttcgtgatggatctgctcacctccacgatcggggtttcttggaaggcgtcggtgccgatcatccggcgggcgacctggccggtgatggcgacgactgggacgctgtccattaaagcgtcggcgaggccgctcacgaggttggtggcgccggggccggaggtggcaatgcagacgccggggaggccggaggaacgcgcgtagccttcggcggcgaagacgccgccctgctcgtggcgcgggagcacgttgcggatggcggcggagcgcgtgagcgcctggtggatctccatcgacgcaccgccggggtacgcgaacaccgtcgtcacgccctgcctctccagcgcctccacaaggatgtccgcgcccttgcgaggttcgccggaggcgaaccgtgacacgaagggctccgtggtcggcgcttccttggtgaagggcgccgccgtggggggtttggagatggaacatttgattttgagagcgtggttgggtttggtgagggtttgatgagagagagggagggtggatctagtaatgcgtttggggaaggtggggtgtgaagaggaagaagagaatcgggtggttctggaagcggtggccgccattgtgttgtgtggcatggttatacttcaaaaactgcacaacaagcctagagttagtacctaaacagtaaatttacaacagagagcaaagacacatgcaaaaatttcagccataaaaaaagttataatagaatttaaagcaaaagtttcattttttaaacatatatacaaacaaactggatttgaaggaagggattaattcccctgctcaaagtttgaattcctattgtgacctatactcgaataaaattgaagcctaaggaatgtatgagaaacaagaaaacaaaacaaaactacagacaaacaagtacaattacaaaattcgctaaaattctgtaatcaccaaaccccatctcagtcagcacaaggcccaaggtttattttgaaataaaaaaaaagtgattttatttctcataagctaaaagaaagaaaggcaattatgaaatgatttcgactagatctgaaagtcaaacgcgtattccgcagatattaaagaaagagtagagtttcacatggatcctagatggacccagttgaggaaaaagcaaggcaaagcaaaccagaagtgcaagatccgaaattgaaccacggaatctaggatttggtagagggagaagaaaagtaccttgagaggtagaagagaagagaagagcagagagatatatgaacgagtgtgtcttggtctcaactctgaagcgatacgagtttagaggggagcattgagttccaatttatagggaaaccgggtggcaggggtgagttaatgacggaaaagcccctaagtaacgagattggattgtgggttagattcaaccgtttgcatccgcggcttagattggggaagtcagagtgaatctcaaccgttgactgagttgaaaattgaatgtagcaaccaattgagccaaccccagcctttgccctttgattttgatttgtttgttgcatactttttatttgtcttctggttctgactctctttctctcgtttcaatgccaggttgcctactcccacaccactcacaagaagattctactgttagtattaaatattttttaatgtattaaatgatgaatgcttttgtaaacagaacaagactatgtctaataagtgtcttgcaacattttttaagaaattaaaaaaaatatatttattatcaaaatcaaatgtatgaaaaatcatgaataatataattttatacatttttttaaaaaatcttttaatttcttaattaatatcttaaaaataatgattaatatttaacccaaaataattagtatgattggtaaggaagatatccatgttatgtttggatgtgagtttgatctagagcaaagcttactagagtcgacctgcagcccgggggatccgcccacgtacggtaccatctgctaatattttaaatcacatgcaagagaggaggcatggttccattttctaccttcacattatttgagaaaaacgaacttgttctgtgttttatttttgcccttcacattagtacaacgtggaagactcatggttacacagaatcatacataagtacaatgcttgtccctaagaaaacaagcactcgttgtattgaacctttacggctcatgcggccgcgaattcactagtgattgaattcgcggccgcttagtccgacttggccttggcggccgcggccgactctttgagcgtgaagatctgcgccgtctcgggcacagcgccgtagttgacaaagaggtgcgcggtcttgaagaaggccgtgatgatgggctcgtcgttcctgcgcacgaggtgcgggtacgcggccgcaaagtgcttggtggcttcgttgagcttgtagtgcggaatgatcgggaacaagtggtggacctggtgcgtgccaatgtggtggctcaggttgtccacgaacgcgccgtacgagcggtcgacgctcgagaggttgcccttgacgtacgtccactccgagtcgccgtaccacggcgtcgcttcgtcgttgtggtgcaagaaggtcgtaatgacgaggaacgaagcaaagacaaagagcggcgcatagtagtagaggcccatgacggcaaagccgagcgagtatgtgaggtacgcgtacgcggcgaagaaggcggcccagacgccgagcgacacgatgacggccgacgcgcggcgaaggaggagcgggtcccacgggtcaaagtggctcatcgtgcgcggggcatacccgaccttcaagtagacaaaccacgcaccgccgagcgtgtagacccattggcgcacgtcctggaggtccttgaccgaccggtgcgggtaaaagatctcgtccttatcaatgttgcccgtgttcttgtggtggtggcggtgcgtcacgcgccagctctcgaacggcgtcaaaatcgcagagtgcatgatgcagccgatgataaagttgacgctgtggtagcgcgagaaggccgagtggccgcagtcgtggccgaccgtgaagaagccccagaagatgacgccctgcacgtagatgtaggtggcgcaaacgagcgcgtggagcagaacgttatcggcaatgaacggcgtcgagcgcgccgcgtagagcagcgccgccgaggccgacgcgttgaagatcgcgcgggccgtgtagtagagcgagaggccgaggttcgactcaaagcacgcgttcgggatcgagtgcttgagctccgtgagcgtcgggaactcgaccttcgtcttatcctcagtcatgcggccgctgaagtattgcttcttagttaacctttcctttctctctcagctatgtgaattcattttgctttcgtcacaatttatatagtgaaattggatctttggagttaacgccttcacaggattatcgtgttagaacaatgctttttcatgttctaattagtagtacattacaaatgtgcactctattcaataagcatcttttggcacgttaataaatcatgtgaaaaaaaaatactactatttcaaagaaagtgttgtaaaaagaaacggaaagagagctggcttcagttgttgagacttgtttgctagtaaaaatggtgtgaagagtgattcatggtgaggtggtttttcgtccctttctgtttgcatgaaaaacaaatggcaagagatgacgtaggattccttcccttaacgattatctgtttttaatttcaaatatacatataggaatttatgaattactaaggttgtaaaatatgctggtcatttatttatggctaaaatatttttttttctcgtaaatataaaaatatttaaaatttatttttatcatattttttatccttataaaattatgtgtacaacctatataaaaaaatatcatatttaatattgattatatgtttaatcaatataaaaaatcattatcatatatttagatttattcgaatatacatctaaacaaaaaataacatattttaattttatgaagaaaaaaaaatattttatcctttatttatttaagattaattaatagttatgtattgtggaaagacttttacacatgcaatagatatactgaatcaattagatgccaatgctgagttggaaatcacttgaggaggggaggagacttgccaatgcttttcagtttcatttaaatgatttagtggaggagatagagtagtgataaaggcatgccccaattttggagtgtatatatgagtggaaataagagagggatagagagaaaaaataaagagagtaaaaataattaatgtgaaatgatatgataaaaaaataaagaaagagataaagagaaaaatgaaatgagagatagatgaaatagagagtagatacatgtttgtttaggttttttttaggaaataacacatttttttctcatcacttattactcactgtcaatttcctctctttcaatcataatgatatgatttgtttaacaaaaatgtgaaaaaacatataaagtaaaatatttttataaattgataaataaaaatttacaaaatttatttcttattaaattgaatagaaaatgaaagaaaagaaaagaaaaagtatatataaaatgatatagctttaaaaagaataaatttttcatatcagtctttttttaataatttagaaatatttaagtatatagcaaaaatataatgtactttacatatgcataaataataatttgaaaatagaactaatagaatagagaaaaaagtaatataataattaactatatgaaaatttagaagggacaatatttttaattaagaatataaacaatatttcttttcatgtaatgagggacggatgtacggggccagtgttggagtcaaagccaaaatagtcacggggaaattaatgcactgcatgactattcgaaaaaattcactagccttacttagatgttagattaatagctagggggtgcagataattttgaaaggcatgaaaaacattaatttgtacattgcaagcttttgatgacaagctttgcaattgttcacactaccttatgccatttataaatagagtgattggcatatgaaggaaatcatgagagtcgaagcgaaaaacaaagcttgagagtgtaggaaaaatacagtttttttggtaaaaatacagtatttgaataggagcgaaaaatatcctttcaaaatgatccttttctttttttttttttttcttgttgttcttggtcagttattcaaaggaaaagggattgaaataaaaacttgcatgtgggatcgtacgtcgagtcgacctgcaggatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcaccatgtctcctaagcggcaagctctgccaatcacaattgatggcgcaacttatgatgtgtctgcttgggtcaatcaccaccctggaggagctgacattatcgagaactatcgcaaccgcgatgcgaccgatgtcttcatggtgatgcactctcaagaagccgtcgccaagttgaagagaatgcctgttatggagccttcctctcctgacacacctgttgcacccaagcctaagcgtgatgagccccaggaggatttccgcaagttgcgggaggaattcatctccaagggtatgttcgagacgagtttcctttggtatttttacaagacttcaactaccgtcggtttgatggtcctttccatcttgatgaccgtgtacacgaattggtatttcaccgctgctttggttcttggcgtgtgctaccaacagctaggctggttgtcccacgactattgccatcaccaggttttcacaaaccgcaagattaacgacgctttcggtctctttttcggtaacgtgatgcagggatactcacagacttggtggaaggataggcacaatggtcaccatgccgccaccaatgtggtcggccatgacccagatattgataacctccccatcctggcttggtctcccgaagatgtcaagagggctactccttcgactcggaatctcatcaagtaccagcagtactacttcattcccaccattgcatcccttaggttcatctggtgcctccaatccatcggcggcgtcatgtcctacaagagcgaggagaggaacctgtactacaagcgccagtacactaaggaggcgattggtctggccctccactgggtgctcaaggccactttctattgcagtgccatgcctagctttgccaccggtttgggatgcttcttgatctccgagctgctcggaggatttggcattgccatcgttgtgtttctgaatcactatcctttggacaaggttgaggagactgtctgggatgagcacgggttcagcgccagccagatccacgagacgttgaacattaagcccggccttctcaccgattgggtctttggtggtctcaactaccagattgagcaccacttgtggcccaacatgcccaggcacaacctcacggcagcttccctggaggtgcagaagttgtgcgccaagcacaacctgccctacagggccccagccatcatccccggggttcagaaattggtcagcttcttaggcgagattgcccagctggctgctgtccctgaatgagcggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacctgca

SEQ ID NO: 45 - DNA, 4311 bp, Artificial Sequence
  palmsid pKR906
agcggccgcaccatggaggtggtgaatgaaatagtctcaattgggcaggaagttttacccaaagttgattatgcccaactctggagtgatgccagtcactgtgaggtgctttacttgtccatcgcatttgtcatcttgaagttcactcttggcccccttggtccaaaaggtcagtctcgtatgaagtttgttttcaccaattacaaccttctcatgtccatttattcgttgggatcattcctctcaatggcatatgccatgtacaccatcggtgttatgtctgacaactgcgagaaggcttttgacaacaacgtcttcaggatcaccacgcagttgttctatttgagcaagttcctggagtatattgactccttctatttgccactgatgggcaagcctctgacctggttgcaattcttccatcatttgggggcaccgatggatatgtggctgttctataattaccgaaatgaagctgtttggatttttgtgctgttgaatggtttcatccactggatcatgtacggttattattggaccagattgatcaagctgaagttccccatgccaaaatccctgattacatcaatgcagatcattcaattcaatgttggtttctacattgtctggaagtacaggaacattccctgttatcgccaagatgggatgaggatgtttggctggttcttcaattacttttatgttggcacagtcttgtgtttgttcttgaatttctatgtgcaaacgtatatcgtcaggaagcacaagggagccaaaaagattcagtgagcggccgcacctgaattccagcacactggcggccgttactagtggatccgagctcggtaccaagcttgatgcatagcttgagtattctaacgcgtcacctaaatagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaagcccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttagcacgtgtcagtcctgctcctcggccacgaagtgcacgcagttgccggccgggtcgcgcagggcgaactcccgcccccacggctgctcgccgatctcggtcatggccggcccggaggcgtcccggaagttcgtggacacgacctccgaccactcggcgtacagctcgtccaggccgcgcacccacacccaggccagggtgttgtccggcaccacctggtcctggaccgcgctgatgaacagggtcacgtcgtcccggaccacaccggcgaagtcgtcctccacgaagtcccgggagaacccgagccggtcggtccagaactcgaccgctccggcgacgtcgcgcgcggtgagcaccggaacggcactggtcaacttggccatggtggccctcctcacgtgctattattgaagcatttatcagggttattgtctcatgagcggatacatatttgaatgtatttagaaaaataaacaaataggggttccgcgcacatttccccgaaaagtgccacctgtatgcggtgtgaaataccgcacagatgcgtaaggagaaaataccgcatcaggaaattgtaagcgttaataattcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcctcgccgtcgggcatgctcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcttgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatcctcatcctgtctcttgatcagagcttgatcccctgcgccatcagatccttggcggcgagaaagccatccagtttactttgcagggcttcccaaccttaccagagggcgccccagctggcaattccggttcgcttgctgtccataaaaccgcccagtctagctatcgccatgtaagcccactgcaagctacctgctttctctttgcgcttgcgttttcccttgtccagatagcccagtagctgacattcatccggggtcagcaccgtttctgcggactggctttctacgtgaaaaggatctaggtgaagatcctttttgataatctcatgcctgacatttatattccccagaacatcaggttaatggcgtttttgatgtcattttcgcggtggctgagatcagccacttcttccccgataacggagaccggcacactggccatatcggtggtcatcatgcgccagctttcatccccgatatgcaccaccgggtaaagttcacgggagactttatctgacagcagacgtgcactggccagggggatcaccatccgtcgccccggcgtgtcaataatatcactctgtacatccacaaacagacgataacggctctctcttttataggtgtaaaccttaaactgccgtacgtataggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggccctctagatgcatgctcgagcggccgccagtgtgatggatatctgcagaattcagg

SEQ ID NO: 46 - DNA, 777 bp, Euglena gracilis
atggaggtggtgaatgaaatagtctcaattgggcaggaagttttacccaaagttgattatgcccaactctggagtgatgccagtcactgtgaggtgctttacttgtccatcgcatttgtcatcttgaagttcactcttggcccccttggtccaaaaggtcagtctcgtatgaagtttgttttcaccaattacaaccttctcatgtccatttattcgttgggatcattcctctcaatggcatatgccatgtacaccatcggtgttatgtctgacaactgcgagaaggcttttgacaacaacgtcttcaggatcaccacgcagttgttctatttgagcaagttcctggagtatattgactccttctatttgccactgatgggcaagcctctgacctggttgcaattcttccatcatttgggggcaccgatggatatgtggctgttctataattaccgaaatgaagctgtttggatttttgtgctgttgaatggtttcatccactggatcatgtacggttattattggaccagattgatcaagctgaagttccccatgccaaaatccctgattacatcaatgcagatcattcaattcaatgttggtttctacattgtctggaagtacaggaacattccctgttatcgccaagatgggatgaggatgtttggctggttcttcaattacttttatgttggcacagtcttgtgtttgttcttgaatttctatgtgcaaacgtatatcgtcaggaagcacaagggagccaaaaagattcagtga

SEQ ID NO: 47 - protein, 258 aa, Euglena gracilis
MEVVNEIVSIGQEVLPKVDYAQLWSDASHCEVLYLSIAFVILKFTLGPLGPKGQSRMKFVFTNYNLLMSIYSLGSFLSMAYAMYTIGVMSDNCEKAFDNNVFRITTQLFYLSKFLEYIDSFYLPLMGKPLTWLQFFHHLGAPMDMWLFYNYRNEAVWIFVLLNGFIHWIMYGYYWTRLIKLKFPMPKSLITSMQIIQFNVGFYIVWKYRNIPCYRQDGMRMFGWFFNYFYVGTVLCLFLNFYVQTYIVRKHKGAKKIQ

SEQ ID NO: 48 - DNA, 1269 bp, Pavlova lutheri
atgggcaagggtggagacggcggcgcgcaggcggtgagcgggaccgacgcgtctctcgctgaggtgagctccgtcgatagcaagagcgtgcacgtcgtgctctacggcaagcgcgtggatgtcacaaagttccagaaggcacacccgggcgggagcaaggtgttccgcatcttccaggagcgcgacgcgacggagcagttcgagtcttaccactcgcccaaggccatcaagatgatggagggcatgctcaagaagtcggaggatgcgcccgcttccgtgcccctgccctcgcggtccaccatgggcacggagttcaaggagatgattgagcgccacaagagggctggtctctacgacccttgcccgttggacgagctgttcaagctcaccatcgtccttgcgcccatcttcgtgggcgcctatctcgtgcggagcggcgtctcgcccctcgcgggcgcgctctccatgggctttggcttctacctcgacggctggcttgctcacgactacctgcatcacgcagtcttcaagggctcggtcaacacgctcgtcaaggcgaacaacgccatgggatacgccctcggcttcctccagggctacgacgtggcctggtggcgcgcgcgccataacacgcaccacgtgtgcaccaacgaggatggttcggacccggacatcaagacggcgcccctgctcatctacgtgcgagagaacccgtccattgccaagcggctcaacttcttccagcgctggcagcagtactactatgtgccgaccatggccatcctcgacctctactggcgcctggagtccatcgcgtacgtggctgtgcgcctgcctaagatgtggatgcaggccgccgctcttgccgctcactacgcgctcctgtgctgggtcttcgcagcgcatctcaacctcatccctctcatgatggttgcacgcggcttcgcgacgggcatcgttgtctttgcaacccactatggtgaggacatcctcgaccgcgagcacgtcgagggcatgacgctcgtcgagcagaccgccaagacctcccgtaacatcacgggcggctggctagtgaacgtgctcacgggcttcatctccctgcagaccgagcatcacctcttccccatgatgcccaccggcaacctaatgactatccagcccgaggtacgcgacttcttcaagaagcatggcctcgagtaccgcgagggcaacctcttccagtgcgtgcaccagaacatcaaggctctcgccttcgagcacctcctccac

SEQ ID NO: 49 - protein, 423 aa, Pavlova lutheri
MGKGGDGGAQAVSGTDASLAEVSSVDSKSVHVVLYGKRVDVTKFQKAHPGGSKVFRIFQERDATEQFESYHSPKAIKMMEGMLKKSEDAPASVPLPSRSTMGTEFKEMIERHKRAGLYDPCPLDELFKLTIVLAPIFVGAYLVRSGVSPLAGALSMGFGFYLDGWLAHDYLHHAVFKGSVNTLVKANNAMGYALGFLQGYDVAWWRARHNTHHVCTNEDGSDPDIKTAPLLIYVRENPSIAKRLNFFQRWQQYYYVPTMAILDLYWRLESIAYVAVRLPKMWMQAAALAAHYALLCWVFAAHLNLIPLMMVARGFATGIVVFATHYGEDILDREHVEGMTLVEQTAKTSRNITGGWLVNVLTGFISLQTEHHLFPMMPTGNLMTIQPEVRDFFKKHGLEYREGNLFQCVHQNIKALAFEHLLH

SEQ ID NO: 50 - DNA, 1260 bp, Tetruetreptia pomquetensis CCMP1491
atgtctcctaagcggcaagctctgccaatcacaattgatggcgcaacttatgatgtgtctgcttgggtcaatcaccaccctggaggagctgacattatcgagaactatcgcaaccgcgatgcgaccgatgtcttcatggtgatgcactctcaagaagccgtcgccaagttgaagagaatgcctgttatggagccttcctctcctgacacacctgttgcacccaagcctaagcgtgatgagccccaggaggatttccgcaagttgcgggaggaattcatctccaagggtatgttcgagacgagtttcctttggtatttttacaagacttcaactaccgtcggtttgatggtcctttccatcttgatgaccgtgtacacgaattggtatttcaccgctgctttggttcttggcgtgtgctaccaacagctaggctggttgtcccacgactattgccatcaccaggttttcacaaaccgcaagattaacgacgctttcggtctctttttcggtaacgtgatgcagggatactcacagacttggtggaaggataggcacaatggtcaccatgccgccaccaatgtggtcggccatgacccagatattgataacctccccatcctggcttggtctcccgaagatgtcaagagggctactccttcgactcggaatctcatcaagtaccagcagtactacttcattcccaccattgcatcccttaggttcatctggtgcctccaatccatcggcggcgtcatgtcctacaagagcgaggagaggaacctgtactacaagcgccagtacactaaggaggcgattggtctggccctccactgggtgctcaaggccactttctattgcagtgccatgcctagctttgccaccggtttgggatgcttcttgatctccgagctgctcggaggatttggcattgccatcgttgtgtttctgaatcactatcctttggacaaggttgaggagactgtctgggatgagcacgggttcagcgccagccagatccacgagacgttgaacattaagcccggccttctcaccgattgggtctttggtggtctcaactaccagattgagcaccacttgtggcccaacatgcccaggcacaacctcacggcagcttccctggaggtgcagaagttgtgcgccaagcacaacctgccctacagggccccagccatcatccccggggttcagaaattggtcagcttcttaggcgagattgcccagctggctgctgtccctgaa

SEQ ID NO: 51 - protein, 420 aa, Tetruetreptia pomquetensis CCMP1491
MSPKRQALPITIDGATYDVSAWVNHHPGGADIIENYRNRDATDAFMVMHSQEAVAKLKRMPVMEPSSPDTPVAPKPKRDEPQEDFRKLREEFISKGMFETSFLWYFYKTSTTVGLMVLSILMTVYTNWYFTAALVLGVCYQQLGWLSHDYCHHQVFTNRKINDAFGLFFGNVMQGYSQTWWKDRHNGHHAATNVVGHDPDIDNLPILAWSPEDVKRATPSTRNLIKYQQYYFIPTIASLRFIWCLQSIGGVMSYKSEERNLYYKRRYTKEAIGLALPWVLKATFYCSAMPSFATGLGCFLISELLGGFGIAIVVFLNHYPLDKVEETVWDEHGFSASQIHETLNIKPGLLTDWVFGGLNYQIEHHLWPNMPRHNLTAASLEVQKLCAKHNLPYRAPAIIPGVQKLVSFLGEIAQLAAVPE

SEQ ID NO: 52 - DNA, 1341 bp, Mortierella alpina
atgggaacggaccaaggaaaaaccttcacctgggaagagctggcggcccataacaccaaggacgacctactcttggccatccgcggcagggtgtacgatgtcacaaagttcttgagccgccatcctggtggagtggacactctcctgctcggagctggccgagatgttactccggtctttgagatgtatcacgcgtttggggctgcagatgccattatgaagaagtactatgtcggtacactggtctcgaatgagctgcccatcttcccggagccaacggtgttccacaaaaccatcaagacgagagtcgagggctactttacggatcggaacattgatcccaagaatagaccagagatctggggacgatacgctcttatctttggatccttgatcgcttcctactacgcgcagctctttgtgcctttcgttgtcgaacgcacatggcttcaggtggtgtttgcaatcatcatgggatttgcgtgcgcacaagtcggactcaaccctcttcatgatgcgtctcacttttcagtgacccacaaccccactgtctggaagattctgggagccacgcacgactttttcaacggagcatcgtacctggtgtggatgtaccaacatatgctcggccatcacccctacaccaacattgctggagcagatcccgacgtgtcgacgtctgagcccgatgttcgtcgtatcaagcccaaccaaaagtggtttgtcaaccacatcaaccagcacatgtttgttcctttcctgtacggactgctggcgttcaaggtgcgcattcaggacatcaacattttgtactttgtcaagaccaatgacgctattcgtgtcaatcccatctcgacatggcacactgtgatgttctggggcggcaaggctttctttgtctggtatcgcctgattgttcccctgcagtatctgcccctgggcaaggtgctgctcttgttcacggtcgcggacatggtgtcgtcttactggctggcgctgaccttccaggcgaaccacgttgttgaggaagttcagtggccgttgcctgacgagaacgggatcatccaaaaggactgggcagctatgcaggtcgagactacgcaggattacgcacacgattcgcacctctggaccagcatcactggcagcttgaactaccaggctgtgcaccatctgttccccaacgtgtcgcagcaccattatcccgatattctggccatcatcaagaacacctgcagcgagtacaaggttccataccttgtcaaggatacgttttggcaagcatttgcttcacatttggagcacttgcgtgttcttggactccgtcccaaggaagagtag

SEQ ID NO: 53 - protein, 446 aa, Mortierella alpina
MGTDQGKTFTWEELAAHNTKDDLLLAIRGRVYDVTKFLSRHPGGVDTLLLGAGRDVTPVFEMYHAFGAADAIMKKYYVGTLVSNELPIFPEPTVFHKTIKTRVEGYFTDRNIDPKNRPEIWGRYALIFGSLIASYYAQLFVPFVVERTWLQVVFAIIMGFACAQVGLNPLHDASHFSVTHNPTVWKILGATHDFFNGASYLVWMYQHMLGHHPYTNIAGADPDVSTSEPDVRRIKPNQKWFVNHINQHMFVPFLYGLLAFKVRIQDINILYFVKTNDAIRVNPISTWHTVMFWGGKAFFVWYRLIVPLQYLPLGKVLLLFTVADMVSSYWLALTFQANHVVEEVQWPLPDENGIIQKDWAAMQVETTQDYAHDSHLWTSITGSLNYQAVHHLFPNVSQHHYPDILAIIKNTCSEYKVPYLVKDTFWQAFASHLEHLRVLGLRPKEE

SEQ ID NO: 54 - DNA, 1350 bp, Euglena gracilis
atggctctcagtcttaccacagaacagctgttagaacgccctgatttggttgcgattgatggcatcctctacgaccttgaagggcttgccaaagttcatccaggaggagatttgattctcgcttctggtgcctctgatgcctcccctctcttttattcaatgcatccatacgtcaaaccggagaattccaaattgcttcaacagttcgtccgagggaagcatgaccgcacctcgaaggacattgtctacacgtatgattctcccttcgcacaagacgttaagcggacaatgcgcgaggtgatgaaagggaggaactggtacgcaacccctggcttctggctgcgcaccgttgggatcatcgccgtgacggccttttgcgagtggcactgggctaccacggggatggtgctgtggggcctgttgactggattcatgcacatgcagatcggcttatccatccagcatgatgcgtcccacggggccatcagcaagaagccttgggtcaacgccctcttcgcctacggcattgacgtcatcggatcgtcccggtggatttggctgcagtcgcacatcatgcggcaccacacctacaccaaccagcacggcctcgacctggatgcggagtcggcagagccgttcctggtgttccacaactaccccgccgcaaacaccgcccgaaagtggttccaccgcttccaagcttggtacatgtaccttgtgctgggggcatacggggtatcgctggtgtacaacccgctctacattttccggatgcagcacaatgacaccatcccagagtctgtcacggccatgcgggagaatggctttctgcggcgctaccgcacacttgcattcgtgatgcgagctttcttcatcttccggaccgcattcttgccctggtacctcactgggacctcattgctgatcaccattcctctggtgcccactgcaactggtgccttcttgacgttcttcttcattttgtcccacaattttgatggctccgaacggatccccgacaagaactgcaaggttaagagctctgagaaggacgttgaggctgaccaaattgactggtatcgggcgcaggtggagacgtcctccacatacggtggccccatcgccatgttcttcactggcggtctcaatttccagatcgagcaccacctctttccccggatgtcgtcttggcactaccccttcgtccagcaggcggtccgggagtgttgcgaacgccatggagtgcgatatgttttctaccctaccatcgtcggcaacatcatctccaccctgaagtacatgcataaggtgggtgtcgtccactgcgtgaaggacgcacaggattcctga

SEQ ID NO: 55 - protein, 449 aa, Euglena gracilis
MALSLTTEQLLERPDLVAIDGILYDLEGLAKVHPGGDLILASGASDASPLFYSMHPYVKPENSKLLQQFVRGKHDRTSKDIVYTYDSPFAQDVKRTMREVMKGRNWYATPGFWLRTVGIIAVTAFCEWHWATTGMVLWGLLTGFMHMQIGLSIQHDASHGAISKKPWVNALFAYGIDVIGSSRWIWLQSHIMRHHTYTNQHGLDLDAESAEPFLVFHNYPAANTARKWFHRFQAWYMYLVLGAYGVSLVYNPLYIFRMQHNDTIPESVTAMRENGFLRRYRTLAFVMRAFFIFRTAFLPWYLTGTSLLITIPLVPTATGAFLTFFFILSHNFDGSERIPDKNCKVKSSEKDVEADQIDWYRAQVETSSTYGGPIAMFFTGGLNFQIEHHLFPRMSSWHYPFVQQAVRECCERHGVRYVFYPTIVGNIISTLKYMHKVGVVHCVKDAQDS

SEQ ID NO: 56 - DNA, 1077 bp, Saprolegnia diclina
atgactgaggataagacgaaggtcgagttcccgacgctcacggagctcaagcactcgatcccgaacgcgtgctttgagtcgaacctcggcctctcgctctactacacggcccgcgcgatcttcaacgcgtcggcctcggcggcgctgctctacgcggcgcgctcgacgccgttcattgccgataacgttctgctccacgcgctcgtttgcgccacctacatctacgtgcagggcgtcatcttctggggcttcttcacggtcggccacgactgcggccactcggccttctcgcgctaccacagcgtcaactttatcatcggctgcatcatgcactctgcgattttgacgccgttcgagagctggcgcgtgacgcaccgccaccaccacaagaacacgggcaacattgataaggacgagatcttttacccgcaccggtcggtcaaggacctccaggacgtgcgccaatgggtctacacgctcggcggtgcgtggtttgtctacttgaaggtcgggtatgccccgcgcacgatgagccactttgacccgtgggacccgctcctccttcgccgcgcgtcggccgtcatcgtgtcgctcggcgtctgggccgccttcttcgccgcgtacgcgtacctcacatactcgctcggctttgccgtcatgggcctctactactatgcgccgctctttgtctttgcttcgttcctcgtcattacgaccttcttgcaccacaacgacgaagcgacgccgtggtacggcgactcggagtggacgtacgtcaagggcaacctctcgagcgtcgaccgctcgtacggcgcgttcgtggacaacctgagccaccacattggcacgcaccaggtccaccacttgttcccgatcattccgcactacaagctcaacgaagccaccaagcactttgcggccgcgtacccgcacctcgtgcgcaggaacgacgagcccatcatcacggccttcttcaagaccgcgcacctctttgtcaactacggcgctgtgcccgagacggcgcagatcttcacgctcaaagagtcggccgcggccgccaaggccaagtcggactaa

SEQ ID NO: 57 - protein, 358 aa, Saprolegnia diclina
MTEDKTKVEFPTLTELKHSIPNACFESNLGLSLYYTARAIFNASASAALLYAARSTPFIADNVLLHALVCATYIYVQGVIFWGFFTVGHDCGHSAFSRYHSVNFIIGCIMHSAILTPFESWRVTHRHHHKNTGNIDKDEIFYPHRSVKDLQDVRQWVYTLGGAWFVYLKVGYAPRTMSHFDPWDPLLLRRASAVIVSLGVWAAFFAAYAYLTYSLGFAVMGLYYYAPLFVFASFLVITTFLHHNDEATPWYGDSEWTYVKGNLSSVDRSYGAFVDNLSHHIGTHQVHHLFPIIPHYKLNEATKHFAAAYPHLVRRNDEPIITAFFKTAHLFVNYGAVPETAQIFTLKESAAAAKAKSD

SEQ ID NO: 58 - DNA, 1209 bp, Fusarium moniliforme
atggcgactcgacagcgaactgccaccactgttgtggtcgaggaccttcccaaggtcactcttgaggccaagtctgaacctgtgttccccgatatcaagaccatcaaggatgccattcccgcgcactgcttccagccctcgctcgtcacctcattctactacgtcttccgcgattttgccatggtctctgccctcgtctgggctgctctcacctacatccccagcatccccgaccagaccctccgcgtcgcagcttggatggtctacggcttcgtccagggtctgttctgcaccggtgtctggattctcggccatgagtgcggccacggtgctttctctctccacggaaaggtcaacaatgtgaccggctggttcctccactcgttcctcctcgtcccctacttcagctggaagtactctcaccaccgccaccaccgcttcaccggccacatggatctcgacatggctttcgtccccaagactgagcccaagccctccaagtcgctcatgattgctggcattgacgtcgccgagcttgttgaggacacccccgctgctcagatggtcaagctcatcttccaccagcttttcggatggcaggcgtacctcttcttcaacgctagctctggcaagggcagcaagcagtgggagcccaagactggcctctccaagtggttccgagtcagtcacttcgagcctaccagcgctgtcttccgccccaacgaggccatcttcatcctcatctccgatatcggtcttgctctaatgggaactgctctgtactttgcttccaagcaagttggtgtttcgaccattctcttcctctaccttgttccctacctgtgggttcaccactggctcgttgccattacctacctccaccaccaccacaccgagctccctcactacaccgctgagggctggacctacgtcaagggagctctcgccactgtcgaccgtgagtttggcttcatcggaaagcacctcttccacggtatcattgagaagcacgttgttcaccatctcttccctaagatccccttctacaaggctgacgaggccaccgaggccatcaagcccgtcattggcgaccactactgccacgacgaccgaagcttcctgggccagctgtggaccatcttcggcacgctcaagtacgtcgagcacgaccctgcccgacccggtgccatgcgatggaacaaggactag

SEQ ID NO: 59 - protein, 402 aa, Fusarium moniliforme
MATRQRTATTVVVEDLPKVTLEAKSEPVFPDIKTIKDAIPAHCFQPSLVTSFYYVFRDFAMVSALVWAALTYIPSIPDQTLRVAAWMVYGFVQGLFCTGVWILGHECGHGAFSLHGKVNNVTGWFLHSFLLVPYFSWKYSHHRHHRFTGHMDLDMAFVPKTEPKPSKSLMIAGIDVAELVEDTPAAQMVKLIFHQLFGWQAYLFFNASSGKGSKQWEPKTGLSKWFRVSHFEPTSAVFRPNEAIFILISDIGLALMGTALYFASKQVGVSTILFLYLVPYLWVHHWLVAITYLHHHHTELPHYTAEGWTYVKGALATVDREFGFIGKHLFHGIIEKHVVHHLFPKIPFYKADEATEAIKPVIGDHYCHDDRSFLGQLWTIFGTLKYVEHDPARPGAMRWNKD

SEQ ID NO: 60 - DNA, 39 bp, Artificial Sequence
  SMART IV oligonucleotide
aagcagtggtatcaacgcagagtggccattacggccggg

SEQ ID NO: 61 - DNA, 37 bp, Artificial Sequence
  adaptor primer from Invitrogen 3'-RACE kit
ggccacgcgtcgactagtacttttttttttttttttt

SEQ ID NO: 62 - DNA, 31 bp, Artificial Sequence
  primer TpomNot-5
gcggccgcaccatgtctcctaagcggcaagc

SEQ ID NO: 63 - DNA, 27 bp, Artificial Sequence
  primer tpomNot-3
gcggccgctcattcagggacagcagcc

SEQ ID NO: 64 - DNA, 4300 bp, Artificial Sequence
  plasmid pLF114-10
taatacgactcactatagggcgaattgggcccgacgtcgcatgctcccggccgccatggcggccgcgggaattcgattggcggccgcaccatgtctcctaagcggcaagctctgccaatcacaattgatggcgcaacttatgatgtgtctgcttgggtcaatcaccaccctggaggagctgacattatcgagaactatcgcaaccgcgatgcgaccgatgtcttcatggtgatgcactctcaagaagccgtcgccaagttgaagagaatgcctgttatggagccttcctctcctgacacacctgttgcacccaagcctaagcgtgatgagccccaggaggatttccgcaagttgcgggaggaattcatctccaagggtatgttcgagacgagtttcctttggtatttttacaagacttcaactaccgtcggtttgatggtcctttccatcttgatgaccgtgtacacgaattggtatttcaccgctgctttggttcttggcgtgtgctaccaacagctaggctggttgtcccacgactattgccatcaccaggttttcacaaaccgcaagattaacgacgctttcggtctctttttcggtaacgtgatgcagggatactcacagacttggtggaaggataggcacaatggtcaccatgccgccaccaatgtggtcggccatgacccagatattgataacctccccatcctggcttggtctcccgaagatgtcaagagggctactccttcgactcggaatctcatcaagtaccagcagtactacttcattcccaccattgcatcccttaggttcatctggtgcctccaatccatcggcggcgtcatgtcctacaagagcgaggagaggaacctgtactacaagcgccagtacactaaggaggcgattggtctggccctccactgggtgctcaaggccactttctattgcagtgccatgcctagctttgccaccggtttgggatgcttcttgatctccgagctgctcggaggatttggcattgccatcgttgtgtttctgaatcactatcctttggacaaggttgaggagactgtctgggatgagcacgggttcagcgccagccagatccacgagacgttgaacattaagcccggccttctcaccgattgggtctttggtggtctcaactaccagattgagcaccacttgtggcccaacatgcccaggcacaacctcacggcagcttccctggaggtgcagaagttgtgcgccaagcacaacctgccctacagggccccagccatcatccccggggttcagaaattggtcagcttcttaggcgagattgcccagctggctgctgtccctgaatgagcggccgcaatcactagtgaattcgcggccgcctgcaggtcgaccatatgggagagctcccaacgcgttggatgcatagcttgagtattctatagtgtcacctaaatagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattg

SEQ ID NO: 65 - DNA, 6021 bp, Artificial Sequence
  plasmid pKR271
ggccgcgaattcaatcactagtgaattcgcggccgcatgagccgtaaaggttcaatacaacgagtgcttgttttcttagggacaagcattgtacttatgtatgattctgtgtaaccatgagtcttccacgttgtactaatgtgaagggcaaaaataaaacacagaacaagttcgtttttctcaaataatgtgaaggtagaaaatggaaccatgcctcctctcttgcatgtgatttaaaatattagcagatggtaccgtacgtgggcggatcccccgggctgcaggaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttgcatgcctgcaggtcgactcgacgtacgatcccacatgcaagtttttatttcaatcccttttcctttgaataactgaccaagaacaacaagaaaaaaaaaaaaaaagaaaaggatcattttgaaaggatatttttcgctcctattcaaatactgtatttttaccaaaaaaactgtatttttcctacactctcaagctttgtttttcgcttcgactctcatgatttccttcatatgccaatcactctatttataaatggcataaggtagtgtgaacaattgcaaagcttgtcatcaaaagcttgcaatgtacaaattaatgtttttcatgcctttcaaaattatctgcaccccctagctattaatctaacatctaagtaaggctagtgaattttttcgaatagtcatgcagtgcattaatttccccgtgactattttggctttgactccaacactggccccgtacatccgtccctcattacatgaaaagaaatattgtttatattcttaattaaaaatattgtcccttctaaattttcatatagttaattattatattacttttttctctattctattagttctattttcaaattattatttatgcatatgtaaagtacattatatttttgctatatacttaaatatttctaaattattaaaaaaagactgatatgaaaaatttattctttttaaagctatatcattttatatatactttttcttttcttttctttcattttctattcaatttaataagaaataaattttgtaaatttttatttatcaatttataaaaatattttactttatatgttttttcacatttttgttaaacaaatcatatcattatgattgaaagagaggaaattgacagtgagtaataagtgatgagaaaaaaatgtgttatttcctaaaaaaaacctaaacaaacatgtatctactctctatttcatctatctctcatttcatttttctctttatctctttctttatttttttatcatatcatttcacattaattatttttactctctttattttttctctctatccctctcttatttccactcatatatacactccaaaattggggcatgcctttatcactactctatctcctccactaaatcatttaaatgaaactgaaaagcattggcaagtctcctcccctcctcaagtgatttccaactcagcattggcatctaattgattcagtatatctattgcatgtgtaaaagtctttccacaatacataactattaattaatcttaaataaataaaggataaaatatttttttttcttcataaaattaaaatatgttattttttgtttagatgtatattcgaataaatctaaatatatgataatgattttttatattgattaaacatataatcaatattaaatatgatatttttttatataggttgtacacataattttataaggataaaaaatatgataaaaataaattttaaatatttttatatttacgagaaaaaaaaatattttagccataaataaatgaccagcatattttacaaccttagtaattcataaattcctatatgtatatttgaaattaaaaacagataatcgttaagggaaggaatcctacgtcatctcttgccatttgtttttcatgcaaacagaaagggacgaaaaaccacctcaccatgaatcactcttcacaccatttttactagcaaacaagtctcaacaactgaagccagctctctttccgtttctttttacaacactttctttgaaatagtagtatttttttttcacatgatttattaacgtgccaaaagatgcttattgaatagagtgcacatttgtaatgtactactaattagaacatgaaaaagcattgttctaacacgataatcctgtgaaggcgttaactccaaagatccaatttcactatataaattgtgacgaaagcaaaatgaattcacatagctgagagagaaaggaaaggttaactaagaagcaatacttcagcggccgcatgactgaggataagacgaaggtcgagttcccgacgctcacggagctcaagcactcgatcccgaacgcgtgctttgagtcgaacctcggcctctcgctctactacacggcccgcgcgatcttcaacgcgtcggcctcggcggcgctgctctacgcggcgcgctcgacgccgttcattgccgataacgttctgctccacgcgctcgtttgcgccacctacatctacgtgcagggcgtcatcttctggggcttcttcacggtcggccacgactgcggccactcggccttctcgcgctaccacagcgtcaactttatcatcggctgcatcatgcactctgcgattttgacgccgttcgagagctggcgcgtgacgcaccgccaccaccacaagaacacgggcaacattgataaggacgagatcttttacccgcaccggtcggtcaaggacctccaggacgtgcgccaatgggtctacacgctcggcggtgcgtggtttgtctacttgaaggtcgggtatgccccgcgcacgatgagccactttgacccgtgggacccgctcctccttcgccgcgcgtcggccgtcatcgtgtcgctcggcgtctgggccgccttcttcgccgcgtacgcgtacctcacatactcgctcggctttgccgtcatgggcctctactactatgcgccgctctttgtctttgcttcgttcctcgtcattacgaccttcttgcaccacaacgacgaagcgacgccgtggtacggcgactcggagtggacgtacgtcaagggcaacctctcgagcgtcgaccgctcgtacggcgcgttcgtggacaacctgagccaccacattggcacgcaccaggtccaccacttgttcccgatcattccgcactacaagctcaacgaagccaccaagcactttgcggccgcgtacccgcacctcgtgcgcaggaacgacgagcccatcatcacggccttcttcaagaccgcgcacctctttgtcaactacggcgctgtgcccgagacggcgcagatcttcacgctcaaagagtcggccgcggccgccaaggccaagtcggactaagc

SEQ ID NO: 66 - DNA, 9892 bp, Artificial Sequence
  plasmid pKR886r
ggtcgactcgacgtacgtctagaggatccgtcgacggcgcgcccgatcatccggatatagttcctcctttcagcaaaaaacccctcaagacccgtttagaggccccaaggggttatgctagttattgctcagcggtggcagcagccaactcagcttcctttcgggctttgttagcagccggatcgatccaagctgtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggcttttccatgggtatatctccttcttaaagttaaacaaaattatttctagagggaaaccgttgtggtctccctatagtgagtcgtattaatttcgcgggatcgagatctgatcaacctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatggacatattgtcgttagaacgcggctacaattaatacataaccttatgtatcatacacatacgatttaggtgacactatagaacggcgcgccaagctgggtctagaactagaaacgtgatgccacttgttattgaagtcgattacagcatctattctgttttactatttataactttgccatttctgacttttgaaaactatctctggatttcggtatcgctttgtgaagatcgagcaaaagagacgttttgtggacgcaatggtccaaatccgttctacatgaacaaattggtcacaatttccactaaaagtaaataaatggcaagttaaaaaaggaatatgcattttactgattgcctaggtgagctccaagagaagttgaatctacacgtctaccaaccgctaaaaaaagaaaaacattgatatgtaacctgattccattagcttttgacttcttcaacagattctctacttagatttctaacagaaatattattactagcacatcattttcagtctcactacagcaaaaaatccaacggcacaatacagacaacaggagatatcagactacagagatagatagatgctactgcatgtagtaagttaaataaaaggaaaataaaatgtcttgctaccaaaactactacagactatgatgctcaccacaggccaaatcctgcaactaggacagcattatcttatatatattgtacaaaacaagcatcaaggaacatttggtctaggcaatcagtacctcgttctaccatcaccctcagttatcacatccttgaaggatccattactgggaatcatcggcaacacatgctcctgatggggcacaatgacatcaagaaggtaggggccaggggtgtccaacattctctgaattgccgctctaagctcttccttcttcgtcactcgcgctgccggtatcccacaagcatcagcaaacttgagcatgtttgggaatatctcgctctcgctagacggatctccaagataggtgtgagctctattggacttgtagaacctatcctccaactgaaccaccatacccaaatgctgattgttcaacaacaatatcttaactgggagattctccactcttatagtggccaactcctgaacattcatgatgaaactaccatccccatcaatgtcaaccacaacagccccagggttagcaacagcagcaccaatagccgcaggcaatccaaaacccatggctccaagaccccctgaggtcaaccactgcctcggtctcttgtacttgtaaaactgcgcagcccacatttgatgctgcccaaccccagtactaacaatagcatctccattagtcaactcatcaagaacctcgatagcatgctgcggagaaatcgcgtcctggaatgtcttgtaacccaatggaaacttgtgtttctgcacattaatctcttctctccaacctccaagatcaaacttaccctccactcctttctcctccaaaatcatattaattcccttcaaggccaacttcaaatccgcgcaaaccgacacgtgcgcctgcttgttcttcccaatctcggcagaatcaatatcaatgtgaacaatcttagccctactagcaaaagcctcaagcttcccagtaacacggtcatcaaaccttaccccaaaggcaagcaacaaatcactattgtcaacagcatagttagcataaacagtaccatgcatacccagcatctgaagggaatattcatcaccaataggaaaagttccaagacccattaaagtgctagcaacgggaataccagtgagttcaacaaagcgcctcaattcagcactggaattcaaactgccaccgccgacgtagagaacgggcttttgggcctccatgatgagtctgacaatgtgttccaattgggcctcggcggggggcctgggcagcctggcgaggtaaccggggaggttaacgggctcgtcccaattaggcacggcgagttgctgctgaacgtctttgggaatgtcgatgaggaccggaccggggcggccggaggtggcgacgaagaaagcctcggcgacgacgcgggggatgtcgtcgacgtcgaggatgaggtagttgtgcttcgtgatggatctgctcacctccacgatcggggtttcttggaaggcgtcggtgccgatcatccggcgggcgacctggccggtgatggcgacgactgggacgctgtccattaaagcgtcggcgaggccgctcacgaggttggtggcgccggggccggaggtggcaatgcagacgccggggaggccggaggaacgcgcgtagccttcggcggcgaagacgccgccctgctcgtggcgcgggagcacgttgcggatggcggcggagcgcgtgagcgcctggtggatctccatcgacgcaccgccggggtacgcgaacaccgtcgtcacgccctgcctctccagcgcctccacaaggatgtccgcgcccttgcgaggttcgccggaggcgaaccgtgacacgaagggctccgtggtcggcgcttccttggtgaagggcgccgccgtggggggtttggagatggaacatttgattttgagagcgtggttgggtttggtgagggtttgatgagagagagggagggtggatctagtaatgcgtttggggaaggtggggtgtgaagaggaagaagagaatcgggtggttctggaagcggtggccgccattgtgttgtgtggcatggttatacttcaaaaactgcacaacaagcctagagttagtacctaaacagtaaatttacaacagagagcaaagacacatgcaaaaatttcagccataaaaaaagttataatagaatttaaagcaaaagtttcattttttaaacatatatacaaacaaactggatttgaaggaagggattaattcccctgctcaaagtttgaattcctattgtgacctatactcgaataaaattgaagcctaaggaatgtatgagaaacaagaaaacaaaacaaaactacagacaaacaagtacaattacaaaattcgctaaaattctgtaatcaccaaaccccatctcagtcagcacaaggcccaaggtttattttgaaataaaaaaaaagtgattttatttctcataagctaaaagaaagaaaggcaattatgaaatgatttcgactagatctgaaagtccaacgcgtattccgcagatattaaagaaagagtagagtttcacatggatcctagatggacccagttgaggaaaaagcaaggcaaagcaaaccagaagtgcaagatccgaaattgaaccacggaatctaggatttggtagagggagaagaaaagtaccttgagaggtagaagagaagagaagagcagagagatatatgaacgagtgtgtcttggtctcaactctgaagcgatacgagtttagaggggagcattgagttccaatttatagggaaaccgggtggcaggggtgagttaatgacggaaaagcccctaagtaacgagattggattgtgggttagattcaaccgtttgcatccgcggcttagattggggaagtcagagtgaatctcaaccgttgactgagttgaaaattgaatgtagcaaccaattgagccaaccccagcctttgccctttgattttgatttgtttgttgcatactttttatttgtcttctggttctgactctctttctctcgtttcaatgccaggttgcctactcccacaccactcacaagaagattctactgttagtattaaatattttttaatgtattaaatgatgaatgcttttgtaaacagaacaagactatgtctaataagtgtcttgcaacattttttaagaaattaaaaaaaatatatttattatcaaaatcaaatgtatgaaaaatcatgaataatataattttatacatttttttaaaaaatcttttaatttcttaattaatatcttaaaaataatgattaatatttaacccaaaataattagtatgattggtaaggaagatatccatgttatgtttggatgtgagtttgatctagagcaaagcttactagagtcgacctgcagcccgggggatccgcccacgtacggtaccatctgctaatattttaaatcacatgcaagagaggaggcatggttccattttctaccttcacattatttgagaaaaacgaacttgttctgtgttttatttttgcccttcacattagtacaacgtggaagactcatggttacacagaatcatacataagtacaatgcttgtccctaagaaaacaagcactcgttgtattgaacctttacggctcatgcggccgcgaattcactagtgattgaattcgcggccgcttagtccgacttggccttggcggccgcggccgactctttgagcgtgaagatctgcgccgtctcgggcacagcgccgtagttgacaaagaggtgcgcggtcttgaagaaggccgtgatgatgggctcgtcgttcctgcgcacgaggtgcgggtacgcggccgcaaagtgcttggtggcttcgttgagcttgtagtgcggaatgatcgggaacaagtggtggacctggtgcgtgccaatgtggtggctcaggttgtccacgaacgcgccgtacgagcggtcgacgctcgagaggttgcccttgacgtacgtccactccgagtcgccgtaccacggcgtcgcttcgtcgttgtggtgcaagaaggtcgtaatgacgaggaacgaagcaaagacaaagagcggcgcatagtagtagaggcccatgacggcaaagccgagcgagtatgtgaggtacgcgtacgcggcgaagaaggcggcccagacgccgagcgacacgatgacggccgacgcgcggcgaaggaggagcgggtcccacgggtcaaagtggctcatcgtgcgcggggcatacccgaccttcaagtagacaaaccacgcaccgccgagcgtgtagacccattggcgcacgtcctggaggtccttgaccgaccggtgcgggtaaaagatctcgtccttatcaatgttgcccgtgttcttgtggtggtggcggtgcgtcacgcgccagctctcgaacggcgtcaaaatcgcagagtgcatgatgcagccgatgataaagttgacgctgtggtagcgcgagaaggccgagtggccgcagtcgtggccgaccgtgaagaagccccagaagatgacgccctgcacgtagatgtaggtggcgcaaacgagcgcgtggagcagaacgttatcggcaatgaacggcgtcgagcgcgccgcgtagagcagcgccgccgaggccgacgcgttgaagatcgcgcgggccgtgtagtagagcgagaggccgaggttcgactcaaagcacgcgttcgggatcgagtgcttgagctccgtgagcgtcgggaactcgaccttcgtcttatcctcagtcatgcggccgctgaagtattgcttcttagttaacctttcctttctctctcagctatgtgaattcattttgctttcgtcacaatttatatagtgaaattggatctttggagttaacgccttcacaggattatcgtgttagaacaatgctttttcatgttctaattagtagtacattacaaatgtgcactctattcaataagcatcttttggcacgttaataaatcatgtgaaaaaaaaatactactatttcaaagaaagtgttgtaaaaagaaacggaaagagagctggcttcagttgttgagacttgtttgctagtaaaaatggtgtgaagagtgattcatggtgaggtggtttttcgtccctttctgtttgcatgaaaaacaaatggcaagagatgacgtaggattccttcccttaacgattatctgtttttaatttcaaatatacatataggaatttatgaattactaaggttgtaaaatatgctggtcatttatttatggctaaaatatttttttttctcgtaaatataaaaatatttaaaatttatttttatcatattttttatccttataaaattatgtgtacaacctatataaaaaaatatcatatttaatattgattatatgtttaatcaatataaaaaatcattatcatatatttagatttattcgaatatacatctaaacaaaaaataacatattttaattttatgaagaaaaaaaaatattttatcctttatttatttaagattaattaatagttatgtattgtggaaagacttttacacatgcaatagatatactgaatcaattagatgccaatgctgagttggaaatcacttgaggaggggaggagacttgccaatgcttttcagtttcatttaaatgatttagtggaggagatagagtagtgataaaggcatgccccaattttggagtgtatatatgagtggaaataagagagggatagagagaaaaaataaagagagtaaaaataattaatgtgaaatgatatgataaaaaaataaagaaagagataaagagaaaaatgaaatgagagatagatgaaatagagagtagatacatgtttgtttaggttttttttaggaaataacacatttttttctcatcacttattactcactgtcaatttcctctctttcaatcataatgatatgatttgtttaacaaaaatgtgaaaaaacatataaagtaaaatatttttataaattgataaataaaaatttacaaaatttatttcttattaaattgaatagaaaatgaaagaaaagaaaagaaaaagtatatataaaatgatatagctttaaaaagaataaatttttcatatcagtctttttttaataatttagaaatatttaagtatatagcaaaaatataatgtactttacatatgcataaataataatttgaaaatagaactaatagaatagagaaaaaagtaatataataattaactatatgaaaatttagaagggacaatatttttaattaagaatataaacaatatttcttttcatgtaatgagggacggatgtacggggccagtgttggagtcaaagccaaaatagtcacggggaaattaatgcactgcatgactattcgaaaaaattcactagccttacttagatgttagattaatagctagggggtgcagataattttgaaaggcatgaaaaacattaatttgtacattgcaagcttttgatgacaagctttgcaattgttcacactaccttatgccatttataaatagagtgattggcatatgaaggaaatcatgagagtcgaagcgaaaaacaaagcttgagagtgtaggaaaaatacagtttttttggtaaaaatacagtatttgaataggagcgaaaaatatcctttcaaaatgatccttttctttttttttttttttcttgttgttcttggtcagttattcaaaggaaaagggattgaaataaaaacttgcatgtgggatcgtacgtcgagtcgacctgca

SEQ ID NO: 67 - DNA, 7085 bp, Artificial Sequence
  plasmid pKR72
gtacggatccgtcgacggcgcgcccgatcatccggatatagttcctcctttcagcaaaaaacccctcaagacccgtttagaggccccaaggggttatgctagttattgctcagcggtggcagcagccaactcagcttcctttcgggctttgttagcagccggatcgatccaagctgtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggcttttccatgggtatatctccttcttaaagttaaacaaaattatttctagagggaaaccgttgtggtctccctatagtgagtcgtattaatttcgcgggatcgagatcgatccaattccaatcccacaaaaatctgagcttaacagcacagttgctcctctcagagcagaatcgggtattcaacaccctcatatcaactactacgttgtgtataacggtccacatgccggtatatacgatgactggggttgtacaaaggcggcaacaaacggcgttcccggagttgcacacaagaaatttgccactattacagaggcaagagcagcagctgacgcgtacacaacaagtcagcaaacagacaggttgaacttcatccccaaaggagaagctcaactcaagcccaagagctttgctaaggccctaacaagcccaccaaagcaaaaagcccactggctcacgctaggaaccaaaaggcccagcagtgatccagccccaaaagagatctcctttgccccggagattacaatggacgatttcctctatctttacgatctaggaaggaagttcgaaggtgaaggtgacgacactatgttcaccactgataatgagaaggttagcctcttcaatttcagaaagaatgctgacccacagatggttagagaggcctacgcagcaggtctcatcaagacgatctacccgagtaacaatctccaggagatcaaataccttcccaagaaggttaaagatgcagtcaaaagattcaggactaattgcatcaagaacacagagaaagacatatttctcaagatcagaagtactattccagtatggacgattcaaggcttgcttcataaaccaaggcaagtaatagagattggagtctctaaaaaggtagttcctactgaatctaaggccatgcatggagtctaagattcaaatcgaggatctaacagaactcgccgtgaagactggcgaacagttcatacagagtcttttacgactcaatgacaagaagaaaatcttcgtcaacatggtggagcacgacactctggtctactccaaaaatgtcaaagatacagtctcagaagaccaaagggctattgagacttttcaacaaaggataatttcgggaaacctcctcggattccattgcccagctatctgtcacttcatcgaaaggacagtagaaaaggaaggtggctcctacaaatgccatcattgcgataaaggaaaggctatcattcaagatgcctctgccgacagtggtcccaaagatggacccccacccacgaggagcatcgtggaaaaagaagacgttccaaccacgtcttcaaagcaagtggattgatgtgacatctccactgacgtaagggatgacgcacaatcccactatccttcgcaagacccttcctctatataaggaagttcatttcatttggagaggacacgctcgagctcatttctctattacttcagccataacaaaagaactcttttctcttcttattaaaccatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggccatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacctaaagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgatgtcgaatcgatcaacctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatggacatattgtcgttagaacgcggctacaattaatacataaccttatgtatcatacacatacgatttaggtgacactatagaacggcgcgccaagcttgttgaaacatccctgaagtgtctcattttattttatttattctttgctgataaaaaaataaaataaaagaagctaagcacacggtcaaccattgctctactgctaaaagggttatgtgtagtgttttactgcataaattatgcagcaaacaagacaactcaaattaaaaaatttcctttgcttgtttttttgttgtctctgacttgactttcttgtggaagttggttgtataaggattgggacaccattgtccttcttaatttaattttattctttgctgataaaaaaaaaaatttcatatagtgttaaataataatttgttaaataaccaaaaagtcaaatatgtttactctcgtttaaataattgagattcgtccagcaaggctaaacgattgtatagatttatgacaatatttacttttttatagataaatgttatattataataaatttatatacatatattatatgttatttattattattttaaatccttcaatattttatcaaaccaactcataattttttttttatctgtaagaagcaataaaattaaatagacccactttaaggatgatccaacctttatacagagtaagagagttcaaatagtaccctttcatatacatatcaactaaaatattagaaatatcatggatcaaaccttataaagacattaaataagtggataagtataatatataaatgggtagtatataatatataaatggatacaaacttctctctttataattgttatgtctccttaacatcctaatataatacataagtgggtaatatataatatataaatggagacaaacttcttccattataattgttatgtcttcttaacacttatgtctcgttcacaatgctaaggttagaattgtttagaaagtcttatagtacacatttgtttttgtactatttgaagcattccataagccgtcacgattcagatgatttataataataagaggaaatttatcatagaacaataaggtgcatagatagagtgttaatatatcataacatcctttgtttattcatagaagaagtgagatggagctcagttattatactgttacatggtcggatacaatattccatgctctccatgagctcttacacctacatgcattttagttcatacttgcggccgcagtatatcttaaattctttaatacggtgtactaggatattgaactggttcttgatgatgaaaacctgggccgagattgcagctatttatagtcataggtcttgttaacatgcatggacatttggccacggggtggcatgcagtttgacgggtgttgaaataaacaaaaatgaggtggcggaagagaatacgagtttgaggttgggttagaaacaacaaatgtgagggctcatgatgggttgagttggtgaatgttttgggctgctcgattgacacctttgtgagtacgtgttgttgtgcatggcttttggggtccagtttttttttcttgacgcggcgatcctgatcagctagtggataagtgatgtccactgtgtgtgattgcgtttttgtttgaattttatgaacttagacattgctatgcaaaggatactctcattgtgttttgtcttcttttgttccttggctttttcttatgatccaagagactagtcagtgttgtggcattcgagactaccaagattaattatgatgggggaaggataagtaactgattagtacggactgttaccaaattaattaataagcggcaaatgaagggcatggatcaaaagcttggatctcctgcaggatctggccggccggatctc

SEQ ID NO: 68 - DNA, 32 bp, Artificial Sequence
  primer oCon-1
aatctagacctgcaggatccatgcccttcatt

SEQ ID NO: 69 - DNA, 33 bp, Artificial Sequence
  primer oCon-2
tttctagacctgcaggttgaaacatccctgaag

SEQ ID NO: 70 - DNA, 2635 bp, Artificial Sequence
  modified Kti/NotI/Kti3'Salb3' cassette
  misc_feature (1229)..(1229): n is a, c, g, or t
ggtaccgggccccccctcgaggtcgcccgggggatccgccctaagcttcgtacgtcctcgaagagaagggttaataacacattttttaacatttttaacacaaattttagttatttaaaaatttattaaaaaatttaaaataagaagaggaactctttaaataaatctaacttacaaaatttatgatttttaataagttttcaccaataaaaaatgtcataaaaatatgttaaaaagtatattatcaatattctctttatgataaataaaaagaaaaaaaaaataaaagttaagtgaaaatgagattgaagtgactttaggtgtgtataaatatatcaaccccgccaacaatttatttaatccaaatatattgaagtatattattccatagcctttatttatttatatatttattatataaaagctttatttgttctaggttgttcatgaaatatttttttggttttatctccgttgtaagaaaatcatgtgctttgtgtcgccactcactattgcagctttttcatgcattggtcagattgacggttgattgtatttttgttttttatggttttgtgttatgacttaagtcttcatctctttatctcttcatcaggtttgatggttacctaatatggtccatgggtacatgcatggttaaattaggtggccaactttgttgtgaacgatagaattttttttatattaagtaaactatttttatattatgaaataataataaaaaaaatattttatcattattaacaaaatcatattagttaatttgttaactctataataaaagaaatactgtaacattcacattacatggtaacatctttccaccctttcatttgttttttgtttgatgactttttttcttgtttaaatttatttcccttcttttaaatttggaatacattatcatcatatataaactaaaatactaaaaacaggattacacaaatgataaataataacacaaatatttataaatctagctgcaatatatttaaactagctatatcgatattgtaaaataaaactagctgcattgatactgataaaaaaatatcatgtgctttctggactgatgatgcagtatacttttgacattgcctttattttatttttcagaaaagctttcttagttctgggttcttcattatttgtttcccatctccattgtgaattgaatcatttgcttcgtgtcacaaatacaatttagntaggtacatgcattggtcagattcacggtttattatgtcatgacttaagttcatggtagtacattacctgccacgcatgcattatattggttagatttgataggcaaatttggttgtcaacaatataaatataaataatgtttttatattacgaaataacagtgatcaaaacaaacagttttatctttattaacaagattttgtttttgtttgatgacgttttttaatgtttacgctttcccccttcttttgaatttagaacactttatcatcataaaatcaaatactaaaaaaattacatatttcataaataataacacaaatatttttaaaaaatctgaaataataatgaacaatattacatattatcacgaaaattcattaataaaaatattatataaataaaatgtaatagtagttatatgtaggaaaaaagtactgcacgcataatatatacaaaaagattaaaatgaactattataaataataacactaaattaatggtgaatcatatcaaaataatgaaaaagtaaataaaatttgtaattaacttctatatgtattacacacacaaataataaataatagtaaaaaaaattatgataaatatttaccatctcataagatatttaaaataatgataaaaatatagattattttttatgcaactagctagccaaaaagagaacacgggtatatataaaaagagtacctttaaattctactgtacttcctttattcctgacgtttttatatcaagtggacatacgtgaagattttaattatcagtctaaatatttcattagcacttaatacttttctgttttattcctatcctataagtagtcccgattctcccaacattgcttattcacacaactaactaagaaagtcttccatagccccccaagcggccgcgacacaagtgtgagagtactaaataaatgctttggttgtacgaaatcattacactaaataaaataatcaaagcttatatatgccttccgctaaggccgaatgcaaagaaattggttctttctcgttatcttttgccacttttactagtacgtattaattactacttaatcatctttgtttacggctcattatatccggtctagaggatccaaggccgcgaagttaaaagcaatgttgtcacttgtcgtactaacacatgatgtgatagtttatgctagctagctataacataagctgtctctgagtgtgttgtatattaataaagatcatcactggtgaatggtgatcgtgtacgtaccctacttagtaggcaatggaagcacttagagtgtgctttgtgcatggccttgcctctgttttgagacttttgtaatgttttcgagtttaaatctttgcctttgcgtacgtctagaggatccccgggtacc

SEQ ID NO: 71 - DNA, 9240 bp, Artificial Sequence
  plasmid pKR970
  misc_feature (6592)..(6592): n is a, c, g, or t
gtacggatccgtcgacggcgcgcccgatcatccggatatagttcctcctttcagcaaaaaacccctcaagacccgtttagaggccccaaggggttatgctagttattgctcagcggtggcagcagccaactcagcttcctttcgggctttgttagcagccggatcgatccaagctgtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggcttttccatgggtatatctccttcttaaagttaaacaaaattatttctagagggaaaccgttgtggtctccctatagtgagtcgtattaatttcgcgggatcgagatctgatcaacctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatggacatattgtcgttagaacgcggctacaattaatacataaccttatgtatcatacacatacgatttaggtgacactatagaacggcgcgccaagcttggatctcctgcaggctagcctaagtacgtactcaaaatgccaacaaataaaaaaaaagttgctttaataatgccaaaacaaattaataaaacacttacaacaccggattttttttaattaaaatgtgccatttaggataaatagttaatatttttaataattatttaaaaagccgtatctactaaaatgatttttatttggttgaaaatattaatatgtttaaatcaacacaatctatcaaaattaaactaaaaaaaaaataagtgtacgtggttaacattagtacagtaatataagaggaaaatgagaaattaagaaattgaaagcgagtctaatttttaaattatgaacctgcatatataaaaggaaagaaagaatccaggaagaaaagaaatgaaaccatgcatggtcccctcgtcatcacgagtttctgccatttgcaatagaaacactgaaacacctttctctttgtcacttaattgagatgccgaagccacctcacaccatgaacttcatgaggtgtagcacccaaggcttccatagccatgcatactgaagaatgtctcaagctcagcaccctacttctgtgacgtgtccctcattcaccttcctctcttccctataaataaccacgcctcaggttctccgcttcacaactcaaacattctctccattggtccttaaacactcatcagtcatcaccgcggccgcatgggaacggaccaaggaaaaaccttcacctgggaagagctggcggcccataacaccaaggacgacctactcttggccatccgcggcagggtgtacgatgtcacaaagttcttgagccgccatcctggtggagtggacactctcctgctcggagctggccgagatgttactccggtctttgagatgtatcacgcgtttggggctgcagatgccattatgaagaagtactatgtcggtacactggtctcgaatgagctgcccatcttcccggagccaacggtgttccacaaaaccatcaagacgagagtcgagggctactttacggatcggaacattgatcccaagaatagaccagagatctggggacgatacgctcttatctttggatccttgatcgcttcctactacgcgcagctctttgtgcctttcgttgtcgaacgcacatggcttcaggtggtgtttgcaatcatcatgggatttgcgtgcgcacaagtcggactcaaccctcttcatgatgcgtctcacttttcagtgacccacaaccccactgtctggaagattctgggagccacgcacgactttttcaacggagcatcgtacctggtgtggatgtaccaacatatgctcggccatcacccctacaccaacattgctggagcagatcccgacgtgtcgacgtctgagcccgatgttcgtcgtatcaagcccaaccaaaagtggtttgtcaaccacatcaaccagcacatgtttgttcctttcctgtacggactgctggcgttcaaggtgcgcattcaggacatcaacattttgtactttgtcaagaccaatgacgctattcgtgtcaatcccatctcgacatggcacactgtgatgttctggggcggcaaggctttctttgtctggtatcgcctgattgttcccctgcagtatctgcccctgggcaaggtgctgctcttgttcacggtcgcggacatggtgtcgtcttactggctggcgctgaccttccaggcgaaccacgttgttgaggaagttcagtggccgttgcctgacgagaacgggatcatccaaaaggactgggcagctatgcaggtcgagactacgcaggattacgcacacgattcgcacctctggaccagcatcactggcagcttgaactaccaggctgtgcaccatctgttccccaacgtgtcgcagcaccattatcccgatattctggccatcatcaagaacacctgcagcgagtacaaggttccataccttgtcaaggatacgttttggcaagcatttgcttcacatttggagcacttgcgtgttcttggactccgtcccaaggaagagtaggcggccgcatttcgcaccaaatcaatgaaagtaataatgaaaagtctgaataagaatacttaggcttagatgcctttgttacttgtgtaaaataacttgagtcatgtacctttggcggaaacagaataaataaaaggtgaaattccaatgctctatgtataagttagtaatacttaatgtgttctacggttgtttcaatatcatcaaactctaattgaaactttagaaccacaaatctcaatcttttcttaatgaaatgaaaaatcttaattgtaccatgtttatgttaaacaccttacaattggttggagaggaggaccaaccgatgggacaacattgggagaaagagattcaatggagatttggataggagaacaacattctttttcacttcaatacaagatgagtgcaacactaaggatatgtatgagactttcagaagctacgacaacatagatgagtgaggtggtgattcctagcaagaaagacattagaggaagccaaaatcgaacaaggaagacatcaagggcaagagacaggaccatccatctcaggaaaaggagctttgggatagtccgagaagttgtacaagaaattttttggagggtgagtgatgcattgctggtgactttaactcaatcaaaattgagaaagaaagaaaagggagggggctcacatgtgaatagaagggaaacgggagaattttacagttttgatctaatgggcatcccagctagtggtaacatattcaccatgtttaaccttcacgtaccgggccccccctcgaggtcgcccgggggatccgccctaagcttcgtacgtcctcgaagagaagggttaataacacattttttaacatttttaacacaaattttagttatttaaaaatttattaaaaaatttaaaataagaagaggaactctttaaataaatctaacttacaaaatttatgatttttaataagttttcaccaataaaaaatgtcataaaaatatgttaaaaagtatattatcaatattctctttatgataaataaaaagaaaaaaaaaataaaagttaagtgaaaatgagattgaagtgactttaggtgtgtataaatatatcaaccccgccaacaatttatttaatccaaatatattgaagtatattattccatagcctttatttatttatatatttattatataaaagctttatttgttctaggttgttcatgaaatatttttttggttttatctccgttgtaagaaaatcatgtgctttgtgtcgccactcactattgcagctttttcatgcattggtcagattgacggttgattgtatttttgttttttatggttttgtgttatgacttaagtcttcatctctttatctcttcatcaggtttgatggttacctaatatggtccatgggtacatgcatggttaaattaggtggccaactttgttgtgaacgatagaattttttttatattaagtaaactatttttatattatgaaataataataaaaaaaatattttatcattattaacaaaatcatattagttaatttgttaactctataataaaagaaatactgtaacattcacattacatggtaacatctttccaccctttcatttgttttttgtttgatgactttttttcttgtttaaatttatttcccttcttttaaatttggaatacattatcatcatatataaactaaaatactaaaaacaggattacacaaatgataaataataacacaaatatttataaatctagctgcaatatatttaaactagctatatcgatattgtaaaataaaactagctgcattgatactgataaaaaaatatcatgtgctttctggactgatgatgcagtatacttttgacattgcctttattttatttttcagaaaagctttcttagttctgggttcttcattatttgtttcccatctccattgtgaattgaatcatttgcttcgtgtcacaaatacaatttagntaggtacatgcattggtcagattcacggtttattatgtcatgacttaagttcatggtagtacattacctgccacgcatgcattatattggttagatttgataggcaaatttggttgtcaacaatataaatataaataatgtttttatattacgaaataacagtgatcaaaacaaacagttttatctttattaacaagattttgtttttgtttgatgacgttttttaatgtttacgctttcccccttcttttgaatttagaacactttatcatcataaaatcaaatactaaaaaaattacatatttcataaataataacacaaatatttttaaaaaatctgaaataataatgaacaatattacatattatcacgaaaattcattaataaaaatattatataaataaaatgtaatagtagttatatgtaggaaaaaagtactgcacgcataatatatacaaaaagattaaaatgaactattataaataataacactaaattaatggtgaatcatatcaaaataatgaaaaagtaaataaaatttgtaattaacttctatatgtattacacacacaaataataaataatagtaaaaaaaattatgataaatatttaccatctcataagatatttaaaataatgataaaaatatagattattttttatgcaactagctagccaaaaagagaacacgggtatatataaaaagagtacctttaaattctactgtacttcctttattcctgacgtttttatatcaagtggacatacgtgaagattttaattatcagtctaaatatttcattagcacttaatacttttctgttttattcctatcctataagtagtcccgattctcccaacattgcttattcacacaactaactaagaaagtcttccatagccccccaagcggccgcaccatgggcaagggtggagacggcggcgcgcaggcggtgagcgggaccgacgcgtctctcgctgaggtgagctccgtcgatagcaagagcgtgcacgtcgtgctctacggcaagcgcgtggatgtcacaaagttccagaaggcacacccgggcgggagcaaggtgttccgcatcttccaggagcgcgacgcgacggagcagttcgagtcttaccactcgcccaaggccatcaagatgatggagggcatgctcaagaagtcggaggatgcgcccgcttccgtgcccctgccctcgcggtccaccatgggcacggagttcaaggagatgattgagcgccacaagagggctggtctctacgacccttgcccgttggacgagctgttcaagctcaccatcgtccttgcgcccatcttcgtgggcgcctatctcgtgcggagcggcgtctcgcccctcgcgggcgcgctctccatgggctttggcttctacctcgacggctggcttgctcacgactacctgcatcacgcagtcttcaagggctcggtcaacacgctcgtcaaggcgaacaacgccatgggatacgccctcggcttcctccagggctacgacgtggcctggtggcgcgcgcgccataacacgcaccacgtgtgcaccaacgaggatggttcggacccggacatcaagacggcgcccctgctcatctacgtgcgagagaacccgtccattgccaagcggctcaacttcttccagcgctggcagcagtactactatgtgccgaccatggccatcctcgacctctactggcgcctggagtccatcgcgtacgtggctgtgcgcctgcctaagatgtggatgcaggccgccgctcttgccgctcactacgcgctcctgtgctgggtcttcgcagcgcatctcaacctcatccctctcatgatggttgcacgcggcttcgcgacgggcatcgttgtctttgcaacccactatggtgaggacatcctcgaccgcgagcacgtcgagggcatgacgctcgtcgagcagaccgccaagacctcccgtaacatcacgggcggctggctagtgaacgtgctcacgggcttcatctccctgcagaccgagcatcacctcttccccatgatgcccaccggcaacctaatgactatccagcccgaggtacgcgacttcttcaagaagcatggcctcgagtaccgcgagggcaacctcttccagtgcgtgcaccagaacatcaaggctctcgccttcgagcacctcctccactgagcggccgcgacacaagtgtgagagtactaaataaatgctttggttgtacgaaatcattacactaaataaaataatcaaagcttatatatgccttccgctaaggccgaatgcaaagaaattggttctttctcgttatcttttgccacttttactagtacgtattaattactacttaatcatctttgtttacggctcattatatccggtctagaggatccaaggccgcgaagttaaaagcaatgttgtcacttgtcgtactaacacatgatgtgatagtttatgctagctagctataacataagctgtctctgagtgtgttgtatattaataaagatcatcactggtgaatggtgatcgtgtacgtaccctacttagtaggcaatggaagcacttagagtgtgctttgtgcatggccttgcctctgttttgagacttttgtaatgttttcgagttta

SEQ ID NO: 72 - DNA, 30 bp, Artificial Sequence
  primer PvDES5'Not-1
gcggccgcaccatgggcaagggtggagacg

SEQ ID NO: 73 - DNA, 27 bp, Artificial Sequence
  PvDES3'Not-1
gcggccgctcagtggaggaggtgctcg

SEQ ID NO: 74 - DNA, 4308 bp, Artificial Sequence
  plamsid pLF113
taatacgactcactatagggcgaattgggcccgacgtcgcatgctcccggccgccatggcggccgcgggaattcgattgcggccgcaccatgggcaagggtggagacggcggcgcgcaggcggtgagcgggaccgacgcgtctctcgctgaggtgagctccgtcgatagcaagagcgtgcacgtcgtgctctacggcaagcgcgtggatgtcacaaagttccagaaggcacacccgggcgggagcaaggtgttccgcatcttccaggagcgcgacgcgacggagcagttcgagtcttaccactcgcccaaggccatcaagatgatggagggcatgctcaagaagtcggaggatgcgcccgcttccgtgcccctgccctcgcggtccaccatgggcacggagttcaaggagatgattgagcgccacaagagggctggtctctacgacccttgcccgttggacgagctgttcaagctcaccatcgtccttgcgcccatcttcgtgggcgcctatctcgtgcggagcggcgtctcgcccctcgcgggcgcgctctccatgggctttggcttctacctcgacggctggcttgctcacgactacctgcatcacgcagtcttcaagggctcggtcaacacgctcgtcaaggcgaacaacgccatgggatacgccctcggcttcctccagggctacgacgtggcctggtggcgcgcgcgccataacacgcaccacgtgtgcaccaacgaggatggttcggacccggacatcaagacggcgcccctgctcatctacgtgcgagagaacccgtccattgccaagcggctcaacttcttccagcgctggcagcagtactactatgtgccgaccatggccatcctcgacctctactggcgcctggagtccatcgcgtacgtggctgtgcgcctgcctaagatgtggatgcaggccgccgctcttgccgctcactacgcgctcctgtgctgggtcttcgcagcgcatctcaacctcatccctctcatgatggttgcacgcggcttcgcgacgggcatcgttgtctttgcaacccactatggtgaggacatcctcgaccgcgagcacgtcgagggcatgacgctcgtcgagcagaccgccaagacctcccgtaacatcacgggcggctggctagtgaacgtgctcacgggcttcatctccctgcagaccgagcatcacctcttccccatgatgcccaccggcaacctaatgactatccagcccgaggtacgcgacttcttcaagaagcatggcctcgagtaccgcgagggcaacctcttccagtgcgtgcaccagaacatcaaggctctcgccttcgagcacctcctccactgagcggccgcaatcactagtgaattcgcggccgcctgcaggtcgaccatatgggagagctcccaacgcgttggatgcatagcttgagtattctatagtgtcacctaaatagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattg

SEQ ID NO: 75 - DNA, 5492 bp, Artificial
  plasmid pKR287
ggccgcatttcgcaccaaatcaatgaaagtaataatgaaaagtctgaataagaatacttaggcttagatgcctttgttacttgtgtaaaataacttgagtcatgtacctttggcggaaacagaataaataaaaggtgaaattccaatgctctatgtataagttagtaatacttaatgtgttctacggttgtttcaatatcatcaaactctaattgaaactttagaaccacaaatctcaatcttttcttaatgaaatgaaaaatcttaattgtaccatgtttatgttaaacaccttacaattggttggagaggaggaccaaccgatgggacaacattgggagaaagagattcaatggagatttggataggagaacaacattctttttcacttcaatacaagatgagtgcaacactaaggatatgtatgagactttcagaagctacgacaacatagatgagtgaggtggtgattcctagcaagaaagacattagaggaagccaaaatcgaacaaggaagacatcaagggcaagagacaggaccatccatctcaggaaaaggagctttgggatagtccgagaagttgtacaagaaattttttggagggtgagtgatgcattgctggtgactttaactcaatcaaaattgagaaagaaagaaaagggagggggctcacatgtgaatagaagggaaacgggagaattttacagttttgatctaatgggcatcccagctagtggtaacatattcaccatgtttaaccttcacgtacgtctagaggatccccgggtaccgagctcgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttgcatgcctgcaggctagcctaagtacgtactcaaaatgccaacaaataaaaaaaaagttgctttaataatgccaaaacaaattaataaaacacttacaacaccggattttttttaattaaaatgtgccatttaggataaatagttaatatttttaataattatttaaaaagccgtatctactaaaatgatttttatttggttgaaaatattaatatgtttaaatcaacacaatctatcaaaattaaactaaaaaaaaaataagtgtacgtggttaacattagtacagtaatataagaggaaaatgagaaattaagaaattgaaagcgagtctaatttttaaattatgaacctgcatatataaaaggaaagaaagaatccaggaagaaaagaaatgaaaccatgcatggtcccctcgtcatcacgagtttctgccatttgcaatagaaacactgaaacacctttctctttgtcacttaattgagatgccgaagccacctcacaccatgaacttcatgaggtgtagcacccaaggcttccatagccatgcatactgaagaatgtctcaagctcagcaccctacttctgtgacgtgtccctcattcaccttcctctcttccctataaataaccacgcctcaggttctccgcttcacaactcaaacattctctccattggtccttaaacactcatcagtcatcaccgcggccgcatgggaacggaccaaggaaaaaccttcacctgggaagagctggcggcccataacaccaaggacgacctactcttggccatccgcggcagggtgtacgatgtcacaaagttcttgagccgccatcctggtggagtggacactctcctgctcggagctggccgagatgttactccggtctttgagatgtatcacgcgtttggggctgcagatgccattatgaagaagtactatgtcggtacactggtctcgaatgagctgcccatcttcccggagccaacggtgttccacaaaaccatcaagacgagagtcgagggctactttacggatcggaacattgatcccaagaatagaccagagatctggggacgatacgctcttatctttggatccttgatcgcttcctactacgcgcagctctttgtgcctttcgttgtcgaacgcacatggcttcaggtggtgtttgcaatcatcatgggatttgcgtgcgcacaagtcggactcaaccctcttcatgatgcgtctcacttttcagtgacccacaaccccactgtctggaagattctgggagccacgcacgactttttcaacggagcatcgtacctggtgtggatgtaccaacatatgctcggccatcacccctacaccaacattgctggagcagatcccgacgtgtcgacgtctgagcccgatgttcgtcgtatcaagcccaaccaaaagtggtttgtcaaccacatcaaccagcacatgtttgttcctttcctgtacggactgctggcgttcaaggtgcgcattcaggacatcaacattttgtactttgtcaagaccaatgacgctattcgtgtcaatcccatctcgacatggcacactgtgatgttctggggcggcaaggctttctttgtctggtatcgcctgattgttcccctgcagtatctgcccctgggcaaggtgctgctcttgttcacggtcgcggacatggtgtcgtcttactggctggcgctgaccttccaggcgaaccacgttgttgaggaagttcagtggccgttgcctgacgagaacgggatcatccaaaaggactgggcagctatgcaggtcgagactacgcaggattacgcacacgattcgcacctctggaccagcatcactggcagcttgaactaccaggctgtgcaccatctgttccccaacgtgtcgcagcaccattatcccgatattctggccatcatcaagaacacctgcagcgagtacaaggttccataccttgtcaaggatacgttttggcaagcatttgcttcacatttggagcacttgcgtgttcttggactccgtcccaaggaagagtaggc

SEQ ID NO: 76 - DNA, 13293 bp, Artificial Sequence
  plasmid pKR1155
  misc_feature (2769)..(2769): n is a, c, g, or t
ggatctggccggccggatctcgtacgcaaaggcaaagatttaaactcgaaaacattacaaaagtctcaaaacagaggcaaggccatgcacaaagcacactctaagtgcttccattgcctactaagtagggtacgtacacgatcaccattcaccagtgatgatctttattaatatacaacacactcagagacagcttatgttatagctagctagcataaactatcacatcatgtgttagtacgacaagtgacaacattgcttttaacttcgcggccttggatcctctagaccggatataatgagccgtaaacaaagatgattaagtagtaattaatacgtactagtaaaagtggcaaaagataacgagaaagaaccaatttctttgcattcggccttagcggaaggcatatataagctttgattattttatttagtgtaatgatttcgtacaaccaaagcatttatttagtactctcacacttgtgtcgcggccgcttaggaatcctgtgcgtccttcacgcagtggacgacacccaccttatgcatgtacttcagggtggagatgatgttgccgacgatggtagggtagaaaacatatcgcactccatggcgttcgcaacactcccggaccgcctgctggacgaaggggtagtgccaagacgacatccggggaaagaggtggtgctcgatctggaaattgagaccgccagtgaagaacatggcgatggggccaccgtatgtggaggacgtctccacctgcgcccgataccagtcaatttggtcagcctcaacgtccttctcagatctcttaaccttgcagttcttgtcggggatccgttcggagccatcaaaattgtgggacaaaatgaagaagaacgtcaagaaggcaccagttgcggtgggcaccagaggaatggtgatcagcaatgaggtcccagtgaggtaccagggcaagaatgcggtccggaagatgaagaaagctcgcatcacgaatgcaagtgtgcggtagcgccgcagaaagccattttcccgcatggccgtgacagactctgggatggtgtcattgtgctgcatccggaaaatgtagagcgggttgtacaccagcgataccccgtatgcccccagcacaaggtacatgtaccaagcttggaagcggtggaaccactttcgggcggtgtttgcggcggggtagttgtggaacaccaggaacggctctgccgactccgcatccaggtcgaggccgtgctggttggtgtaggtgtggtgccgcatgatgtgcgactgcagccaaatccaccgggacgatccgatgacgtcaatgccgtaggcgaagagggcgttgacccaaggcttcttgctgatggccccgtgggacgcatcatgctggatggataagccgatctgcatgtgcatgaatccagtcaacaggccccacagcaccatccccgtggtagcccagtgccactcgcaaaaggccgtcacggcgatgatcccaacggtgcgcagccagaagccaggggttgcgtaccagttcctccctttcatcacctcgcgcattgtccgcttaacgtcttgtgcgaagggagaatcatacgtgtagacaatgtccttcgaggtgcggtcatgcttccctcggacgaactgttgaagcaatttggaattctccggtttgacgtatggatgcattgaataaaagagaggggaggcatcagaggcaccagaagcgagaatcaaatctcctcctggatgaactttggcaagcccttcaaggtcgtagaggatgccatcaatcgcaaccaaatcagggcgttctaacagctgttctgtggtaagactgagagccatggtttgcggccgcttggggggctatggaagactttcttagttagttgtgtgaataagcaatgttgggagaatcgggactacttataggataggaataaaacagaaaagtattaagtgctaatgaaatatttagactgataattaaaatcttcacgtatgtccacttgatataaaaacgtcaggaataaaggaagtacagtagaatttaaaggtactctttttatatatacccgtgttctctttttggctagctagttgcataaaaaataatctatatttttatcattattttaaatatcttatgagatggtaaatatttatcataattttttttactattatttattatttgtgtgtgtaatacatatagaagttaattacaaattttatttactttttcattattttgatatgattcaccattaatttagtgttattatttataatagttcattttaatctttttgtatatattatgcgtgcagtacttttttcctacatataactactattacattttatttatataatatttttattaatgaattttcgtgataatatgtaatattgttcattattatttcagattttttaaaaatatttgtgttattatttatgaaatatgtaatttttttagtatttgattttatgatgataaagtgttctaaattcaaaagaagggggaaagcgtaaacattaaaaaacgtcatcaaacaaaaacaaaatcttgttaataaagataaaactgtttgttttgatcactgttatttcgtaatataaaaacattatttatatttatattgttgacaaccaaatttgcctatcaaatctaaccaatataatgcatgcgtggcaggtaatgtactaccatgaacttaagtcatgacataataaaccgtgaatctgaccaatgcatgtacctanctaaattgtatttgtgacacgaagcaaatgattcaattcacaatggagatgggaaacaaataatgaagaacccagaactaagaaagcttttctgaaaaataaaataaaggcaatgtcaaaagtatactgcatcatcagtccagaaagcacatgatatttttttatcagtatcaatgcagctagttttattttacaatatcgatatagctagtttaaatatattgcagctagatttataaatatttgtgttattatttatcatttgtgtaatcctgtttttagtattttagtttatatatgatgataatgtattccaaatttaaaagaagggaaataaatttaaacaagaaaaaaagtcatcaaacaaaaaacaaatgaaagggtggaaagatgttaccatgtaatgtgaatgttacagtatttcttttattatagagttaacaaattaactaatatgattttgttaataatgataaaatattttttttattattatttcataatataaaaatagtttacttaatataaaaaaaattctatcgttcacaacaaagttggccacctaatttaaccatgcatgtacccatggaccatattaggtaaccatcaaacctgatgaagagataaagagatgaagacttaagtcataacacaaaaccataaaaaacaaaaatacaatcaaccgtcaatctgaccaatgcatgaaaaagctgcaatagtgagtggcgacacaaagcacatgattttcttacaacggagataaaaccaaaaaaatatttcatgaacaacctagaacaaataaagcttttatataataaatatataaataaataaaggctatggaataatatacttcaatatatttggattaaataaattgttggcggggttgatatatttatacacacctaaagtcacttcaatctcattttcacttaacttttattttttttttctttttatttatcataaagagaatattgataatatactttttaacatatttttatgacattttttattggtgaaaacttattaaaaatcataaattttgtaagttagatttatttaaagagttcctcttcttattttaaattttttaataaatttttaaataactaaaatttgtgttaaaaatgttaaaaaatgtgttattaacccttctcttcgaggacgtacggatccttcatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactccatggaagcagccaaagaattggtttccatcgtccaagaggagctccccaaggtggactatgcccagctttggcaggatgccagcagctgtgaggtcctttacctctcggtggcattcgtggcgatcaagttcatgctgcgcccactggacctgaagcgccaggccaccttgaagaagctgttcacagcatacaacttcctcatgtcgatctattcctttggctccttcctggccatggcctatgccctatcagtaactggcatcctctccggcgactgtgagacggcgttcaacaacgatgtgttcaggatcacaactcagctgttctacctcagcaagttcgtagagtacatcgactccttctaccttccccttatggacaagccactgtcgttccttcagttcttccatcatttgggggcccccattgacatgtggctattctacaaataccgcaacgaaggagtctggatctttgtcctgttgaatgggttcattcactggatcatgtacggttactattggacgcggctcatcaagctgaacttccccatgcccaagaacctgatcacctccatgcagatcatccagttcaatgtcgggttctacatcgtctggaagtaccgcaatgtgccatgctaccgccaggatgggatgcgcatgtttgcctggatcttcaactactggtatgtcgggacggtcttgctgctgttcctcaacttttacgtgcagacgtacatccggaagccgaggaagaaccgagggaagaaggagcccgcccgtccagctggactcccgccggccacgtactacgactccctggcagtgagcggccgcaccatgtctcctaagcggcaagctctgccaatcacaattgatggcgcaacttatgatgtgtctgcttgggtcaatcaccaccctggaggagctgacattatcgagaactatcgcaaccgcgatgcgaccgatgtcttcatggtgatgcactctcaagaagccgtcgccaagttgaagagaatgcctgttatggagccttcctctcctgacacacctgttgcacccaagcctaagcgtgatgagccccaggaggatttccgcaagttgcgggaggaattcatctccaagggtatgttcgagacgagtttcctttggtatttttacaagacttcaactaccgtcggtttgatggtcctttccatcttgatgaccgtgtacacgaattggtatttcaccgctgctttggttcttggcgtgtgctaccaacagctaggctggttgtcccacgactattgccatcaccaggttttcacaaaccgcaagattaacgacgctttcggtctctttttcggtaacgtgatgcagggatactcacagacttggtggaaggataggcacaatggtcaccatgccgccaccaatgtggtcggccatgacccagatattgataacctccccatcctggcttggtctcccgaagatgtcaagagggctactccttcgactcggaatctcatcaagtaccagcagtactacttcattcccaccattgcatcccttaggttcatctggtgcctccaatccatcggcggcgtcatgtcctacaagagcgaggagaggaacctgtactacaagcgccagtacactaaggaggcgattggtctggccctccactgggtgctcaaggccactttctattgcagtgccatgcctagctttgccaccggtttgggatgcttcttgatctccgagctgctcggaggatttggcattgccatcgttgtgtttctgaatcactatcctttggacaaggttgaggagactgtctgggatgagcacgggttcagcgccagccagatccacgagacgttgaacattaagcccggccttctcaccgattgggtctttggtggtctcaactaccagattgagcaccacttgtggcccaacatgcccaggcacaacctcacggcagcttccctggaggtgcagaagttgtgcgccaagcacaacctgccctacagggccccagccatcatccccggggttcagaaattggtcagcttcttaggcgagattgcccagctggctgctgtccctgaatgagcggccgcaagtatgaactaaaatgcacgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaactttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaaggaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtaaagcaatggttgaccgtgtgcttagcttcttttattttatttttttatcagcaaagaataaataaaataaaatgagacacttcagggatgtttcaacggatccgtcgacggcgcgcccgatcatccggatatagttcctcctttcagcaaaaaacccctcaagacccgtttagaggccccaaggggttatgctagttattgctcagcggtggcagcagccaactcagcttcctttcgggctttgttagcagccggatcgatccaagctgtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggcttttccatgggtatatctccttcttaaagttaaacaaaattatttctagagggaaaccgttgtggtctccctatagtgagtcgtattaatttcgcgggatcgagatctgatcaacctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatggacatattgtcgttagaacgcggctacaattaatacataaccttatgtatcatacacatacgatttaggtgacactatagaacggcgcgccaagcttggatctcctgcaggtctcaatagattaagaagttggcgtctcattgattgaccatgggggatcctctagacgtacgtgaaggttaaacatggtgaatatgttaccactagctgggatgcccattagatcaaaactgtaaaattctcccgtttcccttctattcacatgtgagccccctcccttttctttctttctcaattttgattgagttaaagtcaccagcaatgcatcactcaccctccaaaaaatttcttgtacaacttctcggactatcccaaagctccttttcctgagatggatggtcctgtctcttgcccttgatgtcttccttgttcgattttggcttcctctaatgtctttcttgctaggaatcaccacctcactcatctatgttgtcgtagcttctgaaagtctcatacatatccttagtgttgcactcatcttgtattgaagtgaaaaagaatgttgttctcctatccaaatctccattgaatctctttctcccaatgttgtcccatcggttggtcctcctctccaaccaattaattgtaaggtgtttaacataaacatggtacaattaagatttttcatttcattaagaaaagattgagatttgtggttctaaagtttcaattagagtttgatgatattgaaacaaccgtagaacacattaagtattactaacttatacatagagcattggaatttcaccttttatttattctgtttccgccaaaggtacatgactcaagttattttacacaagtaacaaaggcatctaagcctaagtattcttattcagacttttcattattactttcattgatttggtgcgaaatgcggccgctcagaattcctgggcatcctgaattgtgtgggccacgcccaccttctgcatgtagcggagcgtggacattatattctccaggatggtcgggtagtatgtgtagcgcacgccatggcgcttgcaacattcccgcaccgtatcttggatgaaggggtagtgccaagaggacatgcgggggaacaagtggtgctcgatctgcaggttcaaaccgccggtcagcatcatcccgacgctgcccccgtaggtcgccgcggtctcggcctgcgcccggtaccagtccacccggtcctcctctacatcgcggacctccttcccctccttggcccttttggccttgcagttcttttcgggggtccgctcagcgccttcaaagttatgggacagcacaaaaacaaatgtcaagaagatgcctgtgaccgttggcaccagcaggatggtgagcagcggagaggcgcccgcgatgtaccaggggaggaaggcgttgcggaagatgaacagtaggcggagggaaacggcgaaggcgcgctgccggttgaaaaagctgcctggtctaagagaggtggcctctgggattgtgtcgttgtgctgcatcgtgaacaagtacatcggattgtacaccatcgacacaccatacatccccaaaacgatgtacatgtaccacgcctggaaccgatggtaccactttcgtgacgcatttgttgccgggtaggagtggaacaaaatgaacggctccgccgaggcagcgtccaggtccaggccatgctggttggtgtaggtgtggtggcgcataatgtgggactgcagccagatccagcgggaggatccaatggcgtcgatgccgtaggcgaaaaaggcgttcacccagggctttttgctgatggctccgtgagaggcatcgtgttgaatcgccaacccaatctggctgtggaagtacccggtgaagatgccccacatcactgccccggtagtgatccaataccattcgcctatggcagtgcacgcgatgatcagcgcggtccgcagccaaaagccgggcgtggcgtaccagttgcgccccttcatgacctcccgaacgctctgcttgacatcctgggcgaagggactgtcaaaggtgtacactgggtccttcgagcttcgttcgtgtttgcctcgggcaaattgctgcagcagcttcgaattctctggcttcactccagggtgcatggagtagaacagggcggttccgtcggaggcaccggcggcttcaatgaggttgccacctggatgcactttcgccagtccgaagagatcgtacaacaccccatcaattgcaaccagttctgggtgttctaaaagttgctcagtagtcaaagagatggtggccatggtgcggccgcggtgatgactgatgagtgtttaaggaccaatggagagaatgtttgagttgtgaagcggagaacctgaggcgtggttatttatagggaagagaggaaggtgaatgagggacacgtcacagaagtagggtgctgagcttgagacattcttcagtatgcatggctatggaagccttgggtgctacacctcatgaagttcatggtgtgaggtggcttcggcatctcaattaagtgacaaagagaaaggtgtttcagtgtttctattgcaaatggcagaaactcgtgatgacgaggggaccatgcatggtttcatttcttttcttcctggattctttctttccttttatatatgcaggttcataatttaaaaattagactcgctttcaatttcttaatttctcattttcctcttatattactgtactaatgttaaccacgtacacttattttttttttagtttaattttgatagattgtgttgatttaaacatattaatattttcaaccaaataaaaatcattttagtagatacggctttttaaataattattaaaaatattaactatttatcctaaatggcacattttaattaaaaaaaatccggtgttgtaagtgttttattaatttgttttggcattattaaagcaactttttttttatttgttggcattttgagtacgtacttaggctagcctgca

SEQ ID NO: 77 - DNA, 14120 bp, Artificial Sequence
  pKR952
  misc_feature (11120)..(11120): n is a, c, g, or t
gtaccgtacgtgggcggatcccccgggctgcaggtcgactcgacgtacgtctagaggatccgtcgacggcgcgcccgatcatccggatatagttcctcctttcagcaaaaaacccctcaagacccgtttagaggccccaaggggttatgctagttattgctcagcggtggcagcagccaactcagcttcctttcgggctttgttagcagccggatcgatccaagctgtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggcttttccatgggtatatctccttcttaaagttaaacaaaattatttctagagggaaaccgttgtggtctccctatagtgagtcgtattaatttcgcgggatcgagatctgatcaacctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatggacatattgtcgttagaacgcggctacaattaatacataaccttatgtatcatacacatacgatttaggtgacactatagaacggcgcgccaagctgggtctagaactagaaacgtgatgccacttgttattgaagtcgattacagcatctattctgttttactatttataactttgccatttctgacttttgaaaactatctctggatttcggtatcgctttgtgaagatcgagcaaaagagacgttttgtggacgcaatggtccaaatccgttctacatgaacaaattggtcacaatttccactaaaagtaaataaatggcaagttaaaaaaggaatatgcattttactgattgcctaggtgagctccaagagaagttgaatctacacgtctaccaaccgctaaaaaaagaaaaacattgatatgtaacctgattccattagcttttgacttcttcaacagattctctacttagatttctaacagaaatattattactagcacatcattttcagtctcactacagcaaaaaatccaacggcacaatacagacaacaggagatatcagactacagagatagatagatgctactgcatgtagtaagttaaataaaaggaaaataaaatgtcttgctaccaaaactactacagactatgatgctcaccacaggccaaatcctgcaactaggacagcattatcttatatatattgtacaaaacaagcatcaaggaacatttggtctaggcaatcagtacctcgttctaccatcaccctcagttatcacatccttgaaggatccattactgggaatcatcggcaacacatgctcctgatggggcacaatgacatcaagaaggtaggggccaggggtgtccaacattctctgaattgccgctctaagctcttccttcttcgtcactcgcgctgccggtatcccacaagcatcagcaaacttgagcatgtttgggaatatctcgctctcgctagacggatctccaagataggtgtgagctctattggacttgtagaacctatcctccaactgaaccaccatacccaaatgctgattgttcaacaacaatatcttaactgggagattctccactcttatagtggccaactcctgaacattcatgatgaaactaccatccccatcaatgtcaaccacaacagccccagggttagcaacagcagcaccaatagccgcaggcaatccaaaacccatggctccaagaccccctgaggtcaaccactgcctcggtctcttgtacttgtaaaactgcgcagcccacatttgatgctgcccaaccccagtactaacaatagcatctccattagtcaactcatcaagaacctcgatagcatgctgcggagaaatcgcgtcctggaatgtcttgtaacccaatggaaacttgtgtttctgcacattaatctcttctctccaacctccaagatcaaacttaccctccactcctttctcctccaaaatcatattaattcccttcaaggccaacttcaaatccgcgcaaaccgacacgtgcgcctgcttgttcttcccaatctcggcagaatcaatatcaatgtgaacaatcttagccctactagcaaaagcctcaagcttcccagtaacacggtcatcaaaccttaccccaaaggcaagcaacaaatcactattgtcaacagcatagttagcataaacagtaccatgcatacccagcatctgaagggaatattcatcaccaataggaaaagttccaagacccattaaagtgctagcaacgggaataccagtgagttcaacaaagcgcctcaattcagcactggaattcaaactgccaccgccgacgtagagaacgggcttttgggcctccatgatgagtctgacaatgtgttccaattgggcctcggcggggggcctgggcagcctggcgaggtaaccggggaggttaacgggctcgtcccaattaggcacggcgagttgctgctgaacgtctttgggaatgtcgatgaggaccggaccggggcggccggaggtggcgacgaagaaagcctcggcgacgacgcgggggatgtcgtcgacgtcgaggatgaggtagttgtgcttcgtgatggatctgctcacctccacgatcggggtttcttggaaggcgtcggtgccgatcatccggcgggcgacctggccggtgatggcgacgactgggacgctgtccattaaagcgtcggcgaggccgctcacgaggttggtggcgccggggccggaggtggcaatgcagacgccggggaggccggaggaacgcgcgtagccttcggcggcgaagacgccgccctgctcgtggcgcgggagcacgttgcggatggcggcggagcgcgtgagcgcctggtggatctccatcgacgcaccgccggggtacgcgaacaccgtcgtcacgccctgcctctccagcgcctccacaaggatgtccgcgcccttgcgaggttcgccggaggcgaaccgtgacacgaagggctccgtggtcggcgcttccttggtgaagggcgccgccgtggggggtttggagatggaacatttgattttgagagcgtggttgggtttggtgagggtttgatgagagagagggagggtggatctagtaatgcgtttggggaaggtggggtgtgaagaggaagaagagaatcgggtggttctggaagcggtggccgccattgtgttgtgtggcatggttatacttcaaaaactgcacaacaagcctagagttagtacctaaacagtaaatttacaacagagagcaaagacacatgcaaaaatttcagccataaaaaaagttataatagaatttaaagcaaaagtttcattttttaaacatatatacaaacaaactggatttgaaggaagggattaattcccctgctcaaagtttgaattcctattgtgacctatactcgaataaaattgaagcctaaggaatgtatgagaaacaagaaaacaaaacaaaactacagacaaacaagtacaattacaaaattcgctaaaattctgtaatcaccaaaccccatctcagtcagcacaaggcccaaggtttattttgaaataaaaaaaaagtgattttatttctcataagctaaaagaaagaaaggcaattatgaaatgatttcgactagatctgaaagtccaacgcgtattccgcagatattaaagaaagagtagagtttcacatggatcctagatggacccagttgaggaaaaagcaaggcaaagcaaaccagaagtgcaagatccgaaattgaaccacggaatctaggatttggtagagggagaagaaaagtaccttgagaggtagaagagaagagaagagcagagagatatatgaacgagtgtgtcttggtctcaactctgaagcgatacgagtttagaggggagcattgagttccaatttatagggaaaccgggtggcaggggtgagttaatgacggaaaagcccctaagtaacgagattggattgtgggttagattcaaccgtttgcatccgcggcttagattggggaagtcagagtgaatctcaaccgttgactgagttgaaaattgaatgtagcaaccaattgagccaaccccagcctttgccctttgattttgatttgtttgttgcatactttttatttgtcttctggttctgactctctttctctcgtttcaatgccaggttgcctactcccacaccactcacaagaagattctactgttagtattaaatattttttaatgtattaaatgatgaatgcttttgtaaacagaacaagactatgtctaataagtgtcttgcaacattttttaagaaattaaaaaaaatatatttattatcaaaatcaaatgtatgaaaaatcatgaataatataattttatacatttttttaaaaaatcttttaatttcttaattaatatcttaaaaataatgattaatatttaacccaaaataattagtatgattggtaaggaagatatccatgttatgtttggatgtgagtttgatctagagcaaagcttactagagtcgacctgcaggtcgactcgacgtacgatcccacatgcaagtttttatttcaatcccttttcctttgaataactgaccaagaacaacaagaaaaaaaaaaaaaaagaaaaggatcattttgaaaggatatttttcgctcctattcaaatactgtatttttaccaaaaaaactgtatttttcctacactctcaagctttgtttttcgcttcgactctcatgatttccttcatatgccaatcactctatttataaatggcataaggtagtgtgaacaattgcaaagcttgtcatcaaaagcttgcaatgtacaaattaatgtttttcatgcctttcaaaattatctgcaccccctagctattaatctaacatctaagtaaggctagtgaattttttcgaatagtcatgcagtgcattaatttccccgtgactattttggctttgactccaacactggccccgtacatccgtccctcattacatgaaaagaaatattgtttatattcttaattaaaaatattgtcccttctaaattttcatatagttaattattatattacttttttctctattctattagttctattttcaaattattatttatgcatatgtaaagtacattatatttttgctatatacttaaatatttctaaattattaaaaaaagactgatatgaaaaatttattctttttaaagctatatcattttatatatactttttcttttcttttctttcattttctattcaatttaataagaaataaattttgtaaatttttatttatcaatttataaaaatattttactttatatgttttttcacatttttgttaaacaaatcatatcattatgattgaaagagaggaaattgacagtgagtaataagtgatgagaaaaaaatgtgttatttcctaaaaaaaacctaaacaaacatgtatctactctctatttcatctatctctcatttcatttttctctttatctctttctttatttttttatcatatcatttcacattaattatttttactctctttattttttctctctatccctctcttatttccactcatatatacactccaaaattggggcatgcctttatcactactctatctcctccactaaatcatttaaatgaaactgaaaagcattggcaagtctcctcccctcctcaagtgatttccaactcagcattggcatctaattgattcagtatatctattgcatgtgtaaaagtctttccacaatacataactattaattaatcttaaataaataaaggataaaatatttttttttcttcataaaattaaaatatgttattttttgtttagatgtatattcgaataaatctaaatatatgataatgattttttatattgattaaacatataatcaatattaaatatgatatttttttatataggttgtacacataattttataaggataaaaaatatgataaaaataaattttaaatatttttatatttacgagaaaaaaaaatattttagccataaataaatgaccagcatattttacaaccttagtaattcataaattcctatatgtatatttgaaattaaaaacagataatcgttaagggaaggaatcctacgtcatctcttgccatttgtttttcatgcaaacagaaagggacgaaaaaccacctcaccatgaatcactcttcacaccatttttactagcaaacaagtctcaacaactgaagccagctctctttccgtttctttttacaacactttctttgaaatagtagtatttttttttcacatgatttattaacgtgccaaaagatgcttattgaatagagtgcacatttgtaatgtactactaattagaacatgaaaaagcattgttctaacacgataatcctgtgaaggcgttaactccaaagatccaatttcactatataaattgtgacgaaagcaaaatgaattcacatagctgagagagaaaggaaaggttaactaagaagcaatacttcagcggccgcatgactgaggataagacgaaggtcgagttcccgacgctcacggagctcaagcactcgatcccgaacgcgtgctttgagtcgaacctcggcctctcgctctactacacggcccgcgcgatcttcaacgcgtcggcctcggcggcgctgctctacgcggcgcgctcgacgccgttcattgccgataacgttctgctccacgcgctcgtttgcgccacctacatctacgtgcagggcgtcatcttctggggcttcttcacggtcggccacgactgcggccactcggccttctcgcgctaccacagcgtcaactttatcatcggctgcatcatgcactctgcgattttgacgccgttcgagagctggcgcgtgacgcaccgccaccaccacaagaacacgggcaacattgataaggacgagatcttttacccgcaccggtcggtcaaggacctccaggacgtgcgccaatgggtctacacgctcggcggtgcgtggtttgtctacttgaaggtcgggtatgccccgcgcacgatgagccactttgacccgtgggacccgctcctccttcgccgcgcgtcggccgtcatcgtgtcgctcggcgtctgggccgccttcttcgccgcgtacgcgtacctcacatactcgctcggctttgccgtcatgggcctctactactatgcgccgctctttgtctttgcttcgttcctcgtcattacgaccttcttgcaccacaacgacgaagcgacgccgtggtacggcgactcggagtggacgtacgtcaagggcaacctctcgagcgtcgaccgctcgtacggcgcgttcgtggacaacctgagccaccacattggcacgcaccaggtccaccacttgttcccgatcattccgcactacaagctcaacgaagccaccaagcactttgcggccgcgtacccgcacctcgtgcgcaggaacgacgagcccatcatcacggccttcttcaagaccgcgcacctctttgtcaactacggcgctgtgcccgagacggcgcagatcttcacgctcaaagagtcggccgcggccgccaaggccaagtcggactaagcggccgcgaattcaatcactagtgaattcgcggccgcatgagccgtaaaggttcaatacaacgagtgcttgttttcttagggacaagcattgtacttatgtatgattctgtgtaaccatgagtcttccacgttgtactaatgtgaagggcaaaaataaaacacagaacaagttcgtttttctcaaataatgtgaaggtagaaaatggaaccatgcctcctctcttgcatgtgatttaaaatattagcagatggtaccgggccccccctcgaggtcgcccgggggatccgccctaagcttcgtacgtcctcgaagagaagggttaataacacattttttaacatttttaacacaaattttagttatttaaaaatttattaaaaaatttaaaataagaagaggaactctttaaataaatctaacttacaaaatttatgatttttaataagttttcaccaataaaaaatgtcataaaaatatgttaaaaagtatattatcaatattctctttatgataaataaaaagaaaaaaaaaataaaagttaagtgaaaatgagattgaagtgactttaggtgtgtataaatatatcaaccccgccaacaatttatttaatccaaatatattgaagtatattattccatagcctttatttatttatatatttattatataaaagctttatttgttctaggttgttcatgaaatatttttttggttttatctccgttgtaagaaaatcatgtgctttgtgtcgccactcactattgcagctttttcatgcattggtcagattgacggttgattgtatttttgttttttatggttttgtgttatgacttaagtcttcatctctttatctcttcatcaggtttgatggttacctaatatggtccatgggtacatgcatggttaaattaggtggccaactttgttgtgaacgatagaattttttttatattaagtaaactatttttatattatgaaataataataaaaaaaatattttatcattattaacaaaatcatattagttaatttgttaactctataataaaagaaatactgtaacattcacattacatggtaacatctttccaccctttcatttgttttttgtttgatgactttttttcttgtttaaatttatttcccttcttttaaatttggaatacattatcatcatatataaactaaaatactaaaaacaggattacacaaatgataaataataacacaaatatttataaatctagctgcaatatatttaaactagctatatcgatattgtaaaataaaactagctgcattgatactgataaaaaaatatcatgtgctttctggactgatgatgcagtatacttttgacattgcctttattttatttttcagaaaagctttcttagttctgggttcttcattatttgtttcccatctccattgtgaattgaatcatttgcttcgtgtcacaaatacaatttagntaggtacatgcattggtcagattcacggtttattatgtcatgacttaagttcatggtagtacattacctgccacgcatgcattatattggttagatttgataggcaaatttggttgtcaacaatataaatataaataatgtttttatattacgaaataacagtgatcaaaacaaacagttttatctttattaacaagattttgtttttgtttgatgacgttttttaatgtttacgctttcccccttcttttgaatttagaacactttatcatcataaaatcaaatactaaaaaaattacatatttcataaataataacacaaatatttttaaaaaatctgaaataataatgaacaatattacatattatcacgaaaattcattaataaaaatattatataaataaaatgtaatagtagttatatgtaggaaaaaagtactgcacgcataatatatacaaaaagattaaaatgaactattataaataataacactaaattaatggtgaatcatatcaaaataatgaaaaagtaaataaaatttgtaattaacttctatatgtattacacacacaaataataaataatagtaaaaaaaattatgataaatatttaccatctcataagatatttaaaataatgataaaaatatagattattttttatgcaactagctagccaaaaagagaacacgggtatatataaaaagagtacctttaaattctactgtacttcctttattcctgacgtttttatatcaagtggacatacgtgaagattttaattatcagtctaaatatttcattagcacttaatacttttctgttttattcctatcctataagtagtcccgattctcccaacattgcttattcacacaactaactaagaaagtcttccatagccccccaagcggccgccaattcatgacggtgggcggcgatgaggtgtacagcatggcgcaggtgcgcgaccacaacaccccggacgacgcctggtgcgccatccacggcgaggtgtacgagctgaccaagttcgcccgcacccaccccgggggggacatcatcttgctggccgccggcaaggaggccaccatcctgttcgagacgtaccacgtgcgccccatctccgacgcggtcctgcgcaagtaccgcatcggcaagctcgccgccgccggcaaggatgagccggccaacgacagcacctactacagctgggacagcgacttttacaaggtgctccgccagcgtgtcgtggcgcgtctcgaggagcgcaagatcgcccgccgcggcggccccgagatctggatcaaggccgccatcctcgtcagcggcttctggtccatgctctacctcatgtgcaccctggacccgaaccgcggcgccatcctggccgccatcgcgctgggcatcgtcgccgccttcgtcggcacgtgcattcagcacgacggcaaccacggcgcgttcgccttctctccgttcatgaacaagctctctggctggacgctcgacatgatcggcgccagtgccatgacctgggagatgcagcacgtgctgggccaccacccgtacaccaacctgatcgagatggagaacggcacccaaaaggtcacccacgccgacgtcgaccccaagaaggccgaccaggagagcgacccggacgtcttcagcacctaccccatgctccgtctgcacccgtggcaccgcaagcgcttctaccaccgcttccagcacctgtacgcgccgctgctcttcggtttcatgaccatcaacaaggtgatcacccaggatgtgggagttgtcctcagcaagcgtctgtttcagatcgatgccaactgccgttacgccagcaagtcgtacgttgcgcgcttctggatcatgaagctgctcaccgtcctctacatggtcgccctccccgtgtacacccagggccttgtcgacgggctcaagctcttcttcatcgcccacttttcgtgcggcgagctgctggccaccatgttcatcgtcaaccacatcatcgagggcgtctcgtacgcctccaaggactctgtcaagggcaccatggcgccgccgcgcacggtgcacggcgtgaccccgatgcatgacacccgcgacgcgctcggcaaggagaaggcagccaccaagcacgtgccgctcaacgactgggccgcggtccagtgccagacctcggtcaactggtcgatcggctcgtggttctggaaccacttctccggcgggctcaaccaccagatcgagcaccacctcttccccggcctcacccacaccacctacgtgtacattcaggatgtggtgcaggcgacgtgcgccgagtacggggtcccgtaccagtcggagcagagcctcttctccgcctacttcaagatgctctcccaccttcgggcgctcggcaacgagccgatgccctcgtgggagaaggaccaccccaagtccaagtgaaagcttacgcgtcgacccgggtatccgtatgatgtgcctgactacgcatgatatcgcggccgcgacacaagtgtgagagtactaaataaatgctttggttgtacgaaatcattacactaaataaaataatcaaagcttatatatgccttccgctaaggccgaatgcaaagaaattggttctttctcgttatcttttgccacttttactagtacgtattaattactacttaatcatctttgtttacggctcattatatccggtctagaggatccaaggccgcgaagttaaaagcaatgttgtcacttgtcgtactaacacatgatgtgatagtttatgctagctagctataacataagctgtctctgagtgtgttgtatattaataaagatcatcactggtgaatggtgatcgtgtacgtaccctacttagtaggcaatggaagcacttagagtgtgctttgtgcatggccttgcctctgttttgagacttttgtaatgttttcgagtttaaatctttgcctttgcgtacgtctagaggatccccgg

SEQ ID NO: 78 - DNA, 18 bp, Artificial Sequence
  M13F Universal primer
tgtaaaacgacggccagt

SEQ ID NO: 79 - protein, 277 aa, Pavlova sp.
MMLAAGYLLVLSAARQSFQQDIDNPNGAYSTSWTGLPIVMSVVYLSGVFGLTKYFENRKPMTGLKDYMFTYNLYQVIINVWCVVAFLLEVRRAGMSLIGNKVDLGPNSFRLGFVTWVHYNNKYVELLDTLWMVLRKKTQQVSFLHVYHHVLLMWAWFVVVKLGNGGDAYFGGLMNSIIHVMMYSYYTMALLGWSCPWKRYLTQAQLVQFCICLAHSTWAAVTGAYPWRICLVEVWVMVSMLVLFTRFYRQAYAKEAKAKEAKKLAQEASQAKAVKAE

SEQ ID NO: 80 - DNA, 742 bp, Euglena gracilis
attttttttcggtgcggcgcattgtattgcctgcacaatggcggatagcccagtcatcaacctcagcaccatgtggaaacccctttcactgatggctttggaccttgccgttttgggacatgtctggaagcaggcacaacaggagggcagcatttcggcctatgctgattctgtttggactcctctcattatgtccggtttatacttatcaatgatcttcgtggggtgccgctggatgaagaaccgtgaaccctttgagatcaaaacatacatgtttgcgtataacctgtatcagaccttgatgaacctttgcatcgtgttgggattcttgtaccaggtgcatgccactgggatgcgcttttggggaagtggtgtcgaccgaagcccaaaaggtttgggcattggcttcttcatttatgcccactaccacaacaagtatgtggaatattttgatacactttttatggtgctgcgaaagaagaacaaccagatttctttccttcacgtgtatcatcatgccctgttgacatgggcttggtttgctgttgtgtatttcgcacctggaggtgatggctggtttggagcttgctacaattcttccatccatgtcctgatgtactcttactacttgcttgcaacttttggcatcagttgcccatggaagaagatcttgacacagctccagatggttcaattctgtttctgttttacacattccatttatgtgtggatttgcgggtca

SEQ ID NO: 81 - DNA, 2630 bp, Euglena gracilis
attttttttcggtgcggcgcattgtattgcctgcacaatggcggatagcccagtcatcaacctcagcaccatgtggaaacccctttcactgatggctttggaccttgccgttttgggacatgtctggaagcaggcacaacaggagggcagcatttcggcctatgctgattctgtttggactcctctcattatgtccggtttatacttatcaatgatcttcgtggggtgccgctggatgaagaaccgtgaaccctttgagatcaaaacatacatgtttgcgtataacctgtatcagaccttgatgaacctttgcatcgtgttgggattcttgtaccaggtgcatgccactgggatgcgcttttggggaagtggtgtcgaccgaagcccaaaaggtttgggcattggcttcttcatttatgcccactaccacaacaagtatgtggaatattttgatacactttttatggtgctgcgaaagaagaacaaccagatttctttccttcacgtgtatcatcatgccctgttgacatgggcttggtttgctgttgtgtatttcgcacctggaggtgatggctggtttggagcttgctacaattcttccatccatgtcctgatgtactcttactacttgcttgcaacttttggcatcagttgcccatggaagaagatcttgacacagctccagatggttcaattctgtttctgttttacacattccatttatgtgtggatttgcgggtcagagatctacccacggcctctgactgctttgcagtcgttcgtgatggtcaatatgttggtgctgtttggcaatttctatgtcaagcaatactcccaaaagaacggcaagccggagaacggagccacccctgagaacggagcgaagccgcaaccttgcgagaacggcacggtggaaaagcgagagaatgacaccgccaacgttcggcccgcccgtccagctggactcccgccggccacgtactacgactccctggcagtgtcggggcagggcaaggagcggctgttcaccaccgatgaggtgaggcggcacatcctccccaccgatggctggctgacgtgccacgaaggagtctacgatgtcactgatttccttgccaagcaccctggtggcggtgtcatcacgctgggccttggaagggactgcacaatcctcgtcgagtcataccaccctgctgggcgcccggacaaggtgatggagaagtaccgcattggtacgctgcaggaccccaagacgttctatgcttggggagagtccgatttctaccctgagttgaagcgccgggcccttgcaaggctgaaggaggctggtcaggcgcggcgcggcggccttggggtgaaggccctcctggtgctcaccctcttcttcgtgtcgtggtacatgtgggtggcccacaagtccttcctctgggccgccgtctggggcttcgccggctcccacgtcgggctgagcatccagcacgacggcaaccacggcgcgttcagccgcagcacactggtgaaccgcctggcggggtggggcatggacttgatcggcgcgtcgtcaacggtgtgggagtaccagcacgtcatcggccaccaccagtacaccaacctcgtgtcggacacgctattcagtctgcctgagaacgatccggacgtcttctccagctacccgctgatgcgcatgcacccggatacggcgtggcagccgcaccaccgcttccagcacctgttcgcgttcccactgttcgccctgatgacaatcagcaaggtgctgaccagcgatttcgctgtctgcctcagcatgaagaaggggtccatcgactgctcctccaggctcgtcccactggaggggcagctgctgttctggggggccaagctggcgaacttcctgttgcagattgtgttgccatgctacctccacgggacagctatgggcctggccctcttctctgttgcccaccttgtgtcgggggagtacctcgcgatctgcttcatcatcaaccacatcagcgagtcttgtgagtttatgaatacaagctttcaaaccgccgcccggaggacagagatgcttcaggcagcccatcaggcagcggaggccaagaaggtgaagcccacccctccaccgaacgattgggctgtgacacaggtccaatgctgcgtgaattggagatcaggtggcgtgttggccaatcacctctctggaggcttgaaccaccagatcgagcatcatctgttccccagcatctcgcatgccaactaccccatcatcgcccgtgttgtgaaggaggtgtgcgaggagtatgggttgccgtacaagaactacgtcacgttctgggatgcagtctgtggcatggttcagcacctccggttgatgggtgctccaccggtgccaacgaacggggacaaaaagtcataagccacgacatcatttggggctcactccgtgcagccttttcttgggctgcccacgaagatgcgcgatgaggcacctggtggttgccctccgccggcctcggaaaacggttcgacgcctgctccttcagcccagagcactccggcgaagagtgaaagagcactgacctgaattttatgatgacccatttttttaaaaaaaaaaaaaaaaaaaa

SEQ ID NO: 82 - DNA, 2382 bp, Euglena gracilis
atggcggatagcccagtcatcaacctcagcaccatgtggaaacccctttcactgatggctttggaccttgccgttttgggacatgtctggaagcaggcacaacaggagggcagcatttcggcctatgctgattctgtttggactcctctcattatgtccggtttatacttatcaatgatcttcgtggggtgccgctggatgaagaaccgtgaaccctttgagatcaaaacatacatgtttgcgtataacctgtatcagaccttgatgaacctttgcatcgtgttgggattcttgtaccaggtgcatgccactgggatgcgcttttggggaagtggtgtcgaccgaagcccaaaaggtttgggcattggcttcttcatttatgcccactaccacaacaagtatgtggaatattttgatacactttttatggtgctgcgaaagaagaacaaccagatttctttccttcacgtgtatcatcatgccctgttgacatgggcttggtttgctgttgtgtatttcgcacctggaggtgatggctggtttggagcttgctacaattcttccatccatgtcctgatgtactcttactacttgcttgcaacttttggcatcagttgcccatggaagaagatcttgacacagctccagatggttcaattctgtttctgttttacacattccatttatgtgtggatttgcgggtcagagatctacccacggcctctgactgctttgcagtcgttcgtgatggtcaatatgttggtgctgtttggcaatttctatgtcaagcaatactcccaaaagaacggcaagccggagaacggagccacccctgagaacggagcgaagccgcaaccttgcgagaacggcacggtggaaaagcgagagaatgacaccgccaacgttcggcccgcccgtccagctggactcccgccggccacgtactacgactccctggcagtgtcggggcagggcaaggagcggctgttcaccaccgatgaggtgaggcggcacatcctccccaccgatggctggctgacgtgccacgaaggagtctacgatgtcactgatttccttgccaagcaccctggtggcggtgtcatcacgctgggccttggaagggactgcacaatcctcgtcgagtcataccaccctgctgggcgcccggacaaggtgatggagaagtaccgcattggtacgctgcaggaccccaagacgttctatgcttggggagagtccgatttctaccctgagttgaagcgccgggcccttgcaaggctgaaggaggctggtcaggcgcggcgcggcggccttggggtgaaggccctcctggtgctcaccctcttcttcgtgtcgtggtacatgtgggtggcccacaagtccttcctctgggccgccgtctggggcttcgccggctcccacgtcgggctgagcatccagcacgacggcaaccacggcgcgttcagccgcagcacactggtgaaccgcctggcggggtggggcatggacttgatcggcgcgtcgtcaacggtgtgggagtaccagcacgtcatcggccaccaccagtacaccaacctcgtgtcggacacgctattcagtctgcctgagaacgatccggacgtcttctccagctacccgctgatgcgcatgcacccggatacggcgtggcagccgcaccaccgcttccagcacctgttcgcgttcccactgttcgccctgatgacaatcagcaaggtgctgaccagcgatttcgctgtctgcctcagcatgaagaaggggtccatcgactgctcctccaggctcgtcccactggaggggcagctgctgttctggggggccaagctggcgaacttcctgttgcagattgtgttgccatgctacctccacgggacagctatgggcctggccctcttctctgttgcccaccttgtgtcgggggagtacctcgcgatctgcttcatcatcaaccacatcagcgagtcttgtgagtttatgaatacaagctttcaaaccgccgcccggaggacagagatgcttcaggcagcccatcaggcagcggaggccaagaaggtgaagcccacccctccaccgaacgattgggctgtgacacaggtccaatgctgcgtgaattggagatcaggtggcgtgttggccaatcacctctctggaggcttgaaccaccagatcgagcatcatctgttccccagcatctcgcatgccaactaccccatcatcgcccgtgttgtgaaggaggtgtgcgaggagtatgggttgccgtacaagaactacgtcacgttctgggatgcagtctgtggcatggttcagcacctccggttgatgggtgctccaccggtgccaacgaacggggacaaaaagtcataa

SEQ ID NO: 83 - protein, 793 aa, Euglena gracilis
MADSPVINLSTMWKPLSLMALDLAVLGHVWKQAQQEGSISAYADSVWTPLIMSGLYLSMIFVGCRWMKNREPFEIKTYMFAYNLYQTLMNLCIVLGFLYQVHATGMRFWGSGVDRSPKGLGIGFFIYAHYHNKYVEYFDTLFMVLRKKNNQISFLHVYHHALLTWAWFAVVYFAPGGDGWFGACYNSSIHVLMYSYYLLATFGISCPWKKILTQLQMVQFCFCFTHSIYVWICGSEIYPRPLTALQSFVMVNMLVLFGNFYVKQYSQKNGKPENGATPENGAKPQPCENGTVEKRENDTANVRPARPAGLPPATYYDSLAVSGQGKERLFTTDEVRRHILPTDGWLTCHEGVYDVTDFLAKHPGGGVITLGLGRDCTILVESYHPAGRPDKVMEKYRIGTLQDPKTFYAWGESDFYPELKRRALARLKEAGQARRGGLGVKALLVLTLFFVSWYMWVAHKSFLWAAVWGFAGSHVGLSIQHDGNHGAFSRSTLVNRLAGWGMDLIGASSTVWEYQHVIGHHQYTNLVSDTLFSLPENDPDVFSSYPLMRMHPDTAWQPHHRFQHLFAFPLFALMTISKVLTSDFAVCLSMKKGSIDCSSRLVPLEGQLLFWGAKLANFLLQIVLPCYLHGTAMGLALFSVAHLVSGEYLAICFIINHISESCEFMNTSFQTAARRTEMLQAAHQAAEAKKVKPTPPPNDWAVTQVQCCVNWRSGGVLANHLSGGLNHQIEHHLFPSISHANYPIIARVVKEVCEEYGLPYKNYVTFWDAVCGMVQHLRLMGAPPVPTNGDKKS

SEQ ID NO: 84 - protein, 541 aa, Euglena gracilis
MLVLFGNFYVKQYSQKNGKPENGATPENGAKPQPCENGTVEKRENDTANVRPTRPAGPPPATYYDSLAVSGQGKERLFTTDEVRRHILPTDGWLTCHEGVYDVTDFLAKHPGGGVITLGLGRDCTILIESYHPAGRPDKVMEKYRIGTLQDPKTFYAWGESDFYPELKRRALARLKEAGQARRGGLGVKALLVLTLFFVSWYMWVAHKSFLWAAVWGFAGSHVGLSIQHDGNHGAFSRNTLVNRLAGWGMDLIGASSTVWEYQHVIGHHQYTNLVSDTLFSLPENDPDVFSSYPLMRMHPDTAWQPHHRFQHLFAFPLFALMTISKVLTSDFAVCLSMKKGSIDCSSRLVPLEGQLLFWGAKLANFLLQIVLPCYLHGTAMGLALFSVAHLVSGEYLAICFIINHISESCEFMNTSFQTAARRTEMLQAAHQAAEAKKVKPTPPPNDWAVTQVQCCVNWRSGGVLANHLSGGLNHQIEHHLFPSISHANYPTIAPVVKEVCEEYGLPYKNYVTFWDAVCGMVQHLRLMGAPPVPTNGDKKS

SEQ ID NO: 85 - protein, 300 aa, Ostreococcus tauri
MSASGALLPAIASAAYAYATYAYAFEWSHANGIDNVDAREWIGALSLRLPAIATTMYLLFCLVGPRLMAKREAFDPKGFMLAYNAYQTAFNVVVLGMFAREISGLGQPVWGSTMPWSDRKSFKILLGVWLHYNNKYLELLDTVFMVARKKTKQLSFLHVYHHALLIWAWWLVCHLMATNDCIDAYFGAACNSFIHIVMYSYYLMSALGIRCPWKRYITQAQMLQFVIVFAHAVFVLRQKHCPVTLPWAQMFVMTNMLVLFGNFYLKAYSNKSRGDGASSVKPAETTRAPSVRRTRSRKID

SEQ ID NO: 86 - protein, 358 aa, Thalassiosira pseudonana
MCSSPPSQSKTTSLLARYTTAALLLLTLTTWCHFAFPAATATPGLTAEMHSYKVPLGLTVFYLLSLPSLKYVTDNYLAKKYDMKSLLTESMVLYNVAQVLLNGWTVYAIVDAVMNRDHPFIGSRSLVGAALHSGSSYAVWVHYCDKYLEFFDTYFMVLRGKMDQVSFLHIYHHTTIAWAWWIALRFSPGGDIYFGALLNSIIHVLMYSYYALALLKVSCPWKRYLTQAQLLQFTSVVVYTGCTGYTHYYHTKHGADETQPSLGTYYFCCGVQVFEMVSLFVLFSIFYKRSYSKKNKSGGKDSKKNDDGNNEDQCHKAMKDISEGAKEVVGHAAKDAGKLVATASKAVKRKGTRVTGAM

SEQ ID NO: 87 - protein, 515 aa, Thraustochytrium aureum
MTVGFDETVTMDTVRNHNMPDDAWCAIHGTVYDITKFSKVHPGGDIIMLAAGKEATILFETYHIKGVPDAVLRKYKVGKLPQGKKGETSHMPTGLDSASYYSWDSEFYRVLRERVAKKLAEPGLMQRARMELWAKAIFLLAGFWGSLYAMCVLDPHGGAMVAAVTLGVFAAFVGTCIQHDGSHGAFSKSRFMNKAAGWTLDMIGASAMTWEMQHVLGHHPYTNLIEMENGLAKVKGADVDPKKVDQESDPDVFSTYPMLRLHPWHRQRFYHKFQHLYAPLIFGFMTINKVISQDVGVVLRKRLFQIDANCRYGSPWNVARFWIMKLLTTLYMVALPMYMQGPAQGLKLFFMAHFTCGEVLATMFIVNHIIEGVSYASKDAVKGVMAPPRTVHGVTPMQVTQKALSAAESTKSDADKTTMIPLNDWAAVQCQTSVNWAVGSWFWNHFSGGLNHQIEHHCFPQNPHTVNVYISGIVKETCEEYGVPYQAEISLFSAYFKMLSHLRTLGNEDLTAWST

SEQ ID NO: 88 - protein, 509 aa, Schizochytrium aggregatum
MTVGGDEVYSMAQVRDHNTPDDAWCAIHGEVYELTKFARTHPGGDIILLAAGKEATILFETYHVRPISDAVLRKYRIGKLAAAGKDEPANDSTYYSWDSDFYKVLRQRVVARLEERKIARRGGPEIWIKAAILVSGFWSMLYLMCTLDPNRGAILAAIALGIVAAFVGTCIQHDGNHGAFAFSPFMNKLSGWTLDMIGASAMTWEMQHVLGHHPYTNLIEMENGTQKVTHADVDPKKADQESDPDVFSTYPMLRLHPWHRKRFYHRFQHLYAPLLFGFMTINKVITQDVGVVLSKRLFQIDANCRYASKSYVARFWIMKLLTVLYMVALPVYTQGLVDGLKLFFIAHFSCGELLATMFIVNHIIEGVSYASKDSVKGTMAPPRTVHGVTPMHDTRDALGKEKAATKHVPLNDWAAVQCQTSVNWSIGSWFWNHFSGGLNHQIEHHLFPGLTHTTYVYIQDVVQATCAEYGVPYQSEQSLFSAYFKMLSHLRALGNEPMPSWEKDHPKSK

SEQ ID NO: 89 - protein, 550 aa, Thalassiosira pseudonana
MGNGNLPASTAQLKSTSKPQQQHEHRTISKSELAQHNTPKSAWCAVHSTPATDPSHSNNKQHAHLVLDITDFASRHPGGDLILLASGKDASVLFETYHPRGVPTSLIQKLQIGVMEEEAFRDSFYSWTDSDFYTVLKRRVVERLEERGLDRRGSKEIWIKALFLLVGFWYCLYKMYTTSDIDQYGIAIAYSIGMGTFAAFIGTCIQHDGNHGAFAQNKLLNKLAGWTLDMIGASAFTWELQHMLGHHPYTNVLDGVEEERKERGEDVALEEKDQESDPDVFSSFPLMRMHPHHTTSWYHKYQHLYAPPLFALMTLAKVFQQDFEVATSGRLYHIDANVRYGSVWNVMRFWAMKVITMGYMMGLPIYFHGVLRGVGLFVIGHLACGELLATMFIVNHVIEGVSYGTKDLVGGASHGDEKKIVKPTTVLGDTPMEKTREEALKSNSNNNKKKGEKNSVPSVPFNDWAAVQCQTSVNWSPGSWFWNHFSGGLSHQIEHHLFPSICHTNYCHIQDVVESTCAEYGVPYQSESNLFVAYGKMISHLKFLGKAKCE

SEQ ID NO: 90 - protein, 433 aa, Isochrysis galbana
MCNAAQVETQALRAKEAAKPTWTKIHGRTVDVETFRHPGGNILDLFLGMDATTAFETFHGHHKGAWKMLKTLPEKEVAAADIPAQKEEHVAEMTRLMASWRERGLFKPRPVASSIYGLCVIFAIAASVACAPYAPVLAGIAVGTCWAQCGFLQHMGGHREWGRTWSFAFQHLFEGLLKGGSASWWRNRHNKHHAKTNVLGEDGDLRTTPFFAWDPTLAKKVPDWSLRTQAFTFLPALGAYVFVFAFTVRKYSVVKRLWHEVALMVAHYALFSWALSAAGASLSSGLTFYCTGYAWQGIYLGFFFGLSHFAVERVPSTATWLESTMMGTVDWGGSSAFCGYLSGFLNIQIEHHMAPQMPMENLRQIRADCKAAAHKFGLPYRELTFVAATKLMMSGLYRTGKDELKLRADRRKFTRAQAYMGAASALVDTLKAD

SEQ ID NO: 91 - DNA, 909 bp, Euglena gracilis
atggcggatagcccagtcatcaacctcagcaccatgtggaaacccctttcactgatggctttggaccttgccgttttgggacatgtctggaagcaggcacaacaggagggcagcatttcggcctatgctgattctgtttggactcctctcattatgtccggtttatacttatcaatgatcttcgtggggtgccgctggatgaagaaccgtgaaccctttgagatcaaaacatacatgtttgcgtataacctgtatcagaccttgatgaacctttgcatcgtgttgggattcttgtaccaggtgcatgccactgggatgcgcttttggggaagtggtgtcgaccgaagcccaaaaggtttgggcattggcttcttcatttatgcccactaccacaacaagtatgtggaatattttgatacactttttatggtgctgcgaaagaagaacaaccagatttctttccttcacgtgtatcatcatgccctgttgacatgggcttggtttgctgttgtgtatttcgcacctggaggtgatggctggtttggagcttgctacaattcttccatccatgtcctgatgtactcttactacttgcttgcaacttttggcatcagttgcccatggaagaagatcttgacacagctccagatggttcaattctgtttctgttttacacattccatttatgtgtggatttgcgggtcagagatctacccacggcctctgactgctttgcagtcgttcgtgatggtcaatatgttggtgctgtttggcaatttctatgtcaagcaatactcccaaaagaacggcaagccggagaacggagccacccctgagaacggagcgaagccgcaaccttgcgagaacggcacggtggaaaagcgagagaatgacaccgccaacgttcgg

SEQ ID NO: 92 - protein, 303 aa, Euglena gracilis
MADSPVINLSTMWKPLSLMALDLAVLGHVWKQAQQEGSISAYADSVWTPLIMSGLYLSMIFVGCRWMKNREPFEIKTYMFAYNLYQTLMNLCIVLGFLYQVHATGMRFWGSGVDRSPKGLGIGFFIYAHYHNKYVEYFDTLFMVLRKKNNQISFLHVYHHALLTWAWFAVVYFAPGGDGWFGACYNSSIHVLMYSYYLLATFGISCPWKKILTQLQMVQFCFCFTHSIYVWICGSEIYPRPLTALQSFVMVNMLVLFGNFYVKQYSQKNGKPENGATPENGAKPQPCENGTVEKRENDTANVR

SEQ ID NO: 93 - protein, 4 aa, Artificial Sequence
  ng motif
KNGK

SEQ ID NO: 94 - protein, 5 aa, Artificial Sequence
  ng motif
PENGA

SEQ ID NO: 95 - protein, 5 aa, Artificial Sequence
  ng motif
PENGA

SEQ ID NO: 96 - protein, 7 aa, Artificial Sequence
  ng motif
PCENGTV

SEQ ID NO: 97 - DNA, 54 bp, Artificial Sequence
  EgDHAsyn1 proline-rich linker
cccgcccgtccagctggactcccgccggccacgtactacgactccctggcagtg

SEQ ID NO: 98 - protein, 18 aa, Artificial Sequence
  EgDHAsyn1 proline-rich linker
PARPAGLPPATYYDSLAV

SEQ ID NO: 99 - DNA, 3668 bp, Artificial Sequence
  plasmid  pLF121-1
  misc_feature (3616)..(3655): n is a, c, g, or t
gtacaaagttggcattataagaaagcattgcttatcaatttgttgcaacgaacaggtcactatcagtcaaaataaaatcattatttgccatccagctgatatcccctatagtgagtcgtattacatggtcatagctgtttcctggcagctctggcccgtgtctcaaaatctctgatgttacattgcacaagataaaaatatatcatcatgttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcatagatcttttctccatcactgatagggagtggtaaaataactccatcaatgatagagtgtcaacaacatgaccaaaatcccttaacgtgagttacgcgtattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggttacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagggaacgacgcgtaccgctagccaggaagagtttgtagaaacgcaaaaaggccatccgtcaggatggccttctgcttagtttgatgcctggcagtttatggcgggcgtcctgcccgccaccctccgggccgttgcttcacaacgttcaaatccgctcccggcggatttgtcctactcaggagagcgttcaccgacaaacaacagataaaacgaaaggcccagtcttccgactgagcctttcgttttatttgatgcctggcagttccctactctcgcgttaacgctagcatggatgttttcccagtcacgacgttgtaaaacgacggccagtcttaagctcgggccccaaataatgattttattttgactgatagtgacctgttcgttgcaacaaattgatgagcaatgcttttttataatgccaactttgtacaaaaaagttggtttttttcggtctaaaatggaagcagccaaagaattggtttccatcgtccaagaggagctccccaaggtggactatgcccagctttggcaggatgccagcagctgtgaggtcctttacctctcggtggcattcgtggcgatcaagttcatgctgcgcccactggacctgaagcgccaggccaccttgaagaagctgttcacagcatacaacttcctcatgtcgatctattcctttggctccttcctggccatggcctatgccctatcagtaactggcatcctctccggcgactgtgagacggcgttcaacaacgatgtgttcaggatcacaactcagctgttctacctcagcaagttcgtagagtacatcgactccttctaccttccccttatggacaagccactgtcgttccttcagttcttccatcatttgggggcccccattgacatgtggctattctacaaataccgcaacgaaggagtctggatctttgtcctgttgaatgggttcattcactggatcatgtacggttactattggacgcggctcatcaagctgaacttccccatgcccaagaacctgatcacctccatgcagatcatccagttcaatgtcgggttctacatcgtctggaagtaccgcaatgtgccatgctaccgccaggatgggatgcgcatgtttgcctggatcttcaactactggtatgtcgggacggtcttgctgctgttcctcaacttttacgtgcagacgtacatccggaagccgaggaagaaccgagggaagaaggagtaggccacatggcgcctgcgctggaggaaacggtacgctcggatggtgcactgcacttgcactccgccgtttctagcctcccctcgctctaaccactgcggcatgcctgcttgaggcgtgacgttgcctcgtatgatacagtttacacccttcccacagcccacggagctggtgactgtttccagcgtctgcagatcattgatctggtgcaatgtgcacagaccaagcccctctaacgtcttgcggtgtaccgctcgacactcactgcaagagacagatggctgagcatgttatagccccttacattctacccttcgtcccaacctgaccgtcacattcnnnnnnnnnnnnnnnnnnnnnnnnnnnnnnnnnnnnnnnnacccaactttctt

SEQ ID NO: 100 - DNA, 3684 bp, Artificial Sequence
  pLF121-1
  misc_feature (3632)..(3671): n is a, c, g, or t
gtacaaagttggcattataagaaagcattgcttatcaatttgttgcaacgaacaggtcactatcagtcaaaataaaatcattatttgccatccagctgatatcccctatagtgagtcgtattacatggtcatagctgtttcctggcagctctggcccgtgtctcaaaatctctgatgttacattgcacaagataaaaatatatcatcatgttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcatagatcttttctccatcactgatagggagtggtaaaataactccatcaatgatagagtgtcaacaacatgaccaaaatcccttaacgtgagttacgcgtattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggttacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagggaacgacgcgtaccgctagccaggaagagtttgtagaaacgcaaaaaggccatccgtcaggatggccttctgcttagtttgatgcctggcagtttatggcgggcgtcctgcccgccaccctccgggccgttgcttcacaacgttcaaatccgctcccggcggatttgtcctactcaggagagcgttcaccgacaaacaacagataaaacgaaaggcccagtcttccgactgagcctttcgttttatttgatgcctggcagttccctactctcgcgttaacgctagcatggatgttttcccagtcacgacgttgtaaaacgacggccagtcttaagctcgggccccaaataatgattttattttgactgatagtgacctgttcgttgcaacaaattgatgagcaatgcttttttataatgccaactttgtacaaaaaagttggattttttttcggtctaaaatggaagcagccaaagaattggtttccatcgtccaagaggagctccccaaggtggactatgcccagctttggcaggacgccagcagctgtgaggtcctttacctctcggtggcattcgtggcgatcaagttcatgctgcgcccactggacctgaagcgccaggccaccttgaagaagctgttcacagcatacaacttcctcatgtcgatctattcctttggctccttcctggccatggcctatgccctatcagtaactggcatcctctccggcgactgtgagacagcgttcaacaacgatgtgttcaggatcacaactcagctgttctacctcagcaagttcgtagagtacatcgactccttctaccttccccttatggacaagccactgtcgttccttcagttcttccatcatttgggggctcccattgacatgtggctattctacaaataccgcaacgaaggagtctggatctttgtcctgttgaatgggttcattcactggatcatgtacggttactactggacgcggctcatcaagctgaacttccccatgcccaagaacctgatcacctccatgcagatcatccagttcaatgtcgggttctacatcgtctggaagtaccgcaatgtgccatgctaccgccaggatgggatgcgcatgtttgcctggatcttcaactactggtacgtcgggacggtcttgctgctgttcctcaacttttacgtgcagacgtacatccggaagccgaggaagaaccaagggaagaaggagtaggccacatggcgcctgcgctggaggaaacggtacgctcggatggtgcactgcacttgcactccgccgcttctagcctcccctcgctctaacctctgcgacatgcctgcttgaggcgtgacgttgcctcgtgcgatacagtttacacccttcccatggcccacggagcaggtgactgtctccagcgtctgcaattctgatcattggtctggtgcaatgtgcgcagaccaagcccctctaacgtcttgcggtgtaccgctcgacactcactgcacgagacagatggctgagcatgttatagcccctgacattctacccttcgtccttacctgaccgtcacattcatgcttaccnnnnnnnnnnnnnnnnnnnnnnnnnnnnnnnnnnnnnnnnacccaactttctt

SEQ ID NO: 101 - DNA, 774 bp, Euglena anabaena
atggaagcagccaaagaattggtttccatcgtccaagaggagctccccaaggtggactatgcccagctttggcaggatgccagcagctgtgaggtcctttacctctcggtggcattcgtggcgatcaagttcatgctgcgcccactggacctgaagcgccaggccaccttgaagaagctgttcacagcatacaacttcctcatgtcgatctattcctttggctccttcctggccatggcctatgccctatcagtaactggcatcctctccggcgactgtgagacggcgttcaacaacgatgtgttcaggatcacaactcagctgttctacctcagcaagttcgtagagtacatcgactccttctaccttccccttatggacaagccactgtcgttccttcagttcttccatcatttgggggcccccattgacatgtggctattctacaaataccgcaacgaaggagtctggatctttgtcctgttgaatgggttcattcactggatcatgtacggttactattggacgcggctcatcaagctgaacttccccatgcccaagaacctgatcacctccatgcagatcatccagttcaatgtcgggttctacatcgtctggaagtaccgcaatgtgccatgctaccgccaggatgggatgcgcatgtttgcctggatcttcaactactggtatgtcgggacggtcttgctgctgttcctcaacttttacgtgcagacgtacatccggaagccgaggaagaaccgagggaagaaggag

SEQ ID NO: 102 - DNA, 774 bp, Euglena anabaena
atggaagcagccaaagaattggtttccatcgtccaagaggagctccccaaggtggactatgcccagctttggcaggacgccagcagctgtgaggtcctttacctctcggtggcattcgtggcgatcaagttcatgctgcgcccactggacctgaagcgccaggccaccttgaagaagctgttcacagcatacaacttcctcatgtcgatctattcctttggctccttcctggccatggcctatgccctatcagtaactggcatcctctccggcgactgtgagacagcgttcaacaacgatgtgttcaggatcacaactcagctgttctacctcagcaagttcgtagagtacatcgactccttctaccttccccttatggacaagccactgtcgttccttcagttcttccatcatttgggggctcccattgacatgtggctattctacaaataccgcaacgaaggagtctggatctttgtcctgttgaatgggttcattcactggatcatgtacggttactactggacgcggctcatcaagctgaacttccccatgcccaagaacctgatcacctccatgcagatcatccagttcaatgtcgggttctacatcgtctggaagtaccgcaatgtgccatgctaccgccaggatgggatgcgcatgtttgcctggatcttcaactactggtacgtcgggacggtcttgctgctgttcctcaacttttacgtgcagacgtacatccggaagccgaggaagaaccaagggaagaaggag

SEQ ID NO: 103 - protein, 258 aa, Euglena anabaena
MEAAKELVSIVQEELPKVDYAQLWQDASSCEVLYLSVAFVAIKFMLRPLDLKRQATLKKLFTAYNFLMSIYSFGSFLAMAYALSVTGILSGDCETAFNNDVFRITTQLFYLSKFVEYIDSFYLPLMDKPLSFLQFFHHLGAPIDMWLFYKYRNEGVWIFVLLNGFIHWIMYGYYWTRLIKLNFPMPKNLITSMQIIQFNVGFYIVWKYRNVPCYRQDGMRMFAWIFNYWYVGTVLLLFLNFYVQTYIRKPRKNRGKKE

SEQ ID NO: 104 - protein, 258 aa, Euglena anabaena
MEAAKELVSIVQEELPKVDYAQLWQDASSCEVLYLSVAFVAIKFMLRPLDLKRQATLKKLFTAYNFLMSIYSFGSFLAMAYALSVTGILSGDCETAFNNDVFRITTQLFYLSKFVEYIDSFYLPLMDKPLSFLQFFHHLGAPIDMWLFYKYRNEGVWIFVLLNGFIHWIMYGYYWTRLIKLNFPMPKNLITSMQIIQFNVGFYIVWKYRNVPCYRQDGMRMFAWIFNYWYVGTVLLLFLNFYVQTYIRKPRKNQGKKE

SEQ ID NO: 105 - DNA, 4276 bp, Artificial Sequence
  pLF119
gtacaaagttggcattataagaaagcattgcttatcaatttgttgcaacgaacaggtcactatcagtcaaaataaaatcattatttgccatccagctgatatcccctatagtgagtcgtattacatggtcatagctgtttcctggcagctctggcccgtgtctcaaaatctctgatgttacattgcacaagataaaaatatatcatcatgttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcatagatcttttctccatcactgatagggagtggtaaaataactccatcaatgatagagtgtcaacaacatgaccaaaatcccttaacgtgagttacgcgtattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggttacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagggaacgacgcgtaccgctagccaggaagagtttgtagaaacgcaaaaaggccatccgtcaggatggccttctgcttagtttgatgcctggcagtttatggcgggcgtcctgcccgccaccctccgggccgttgcttcacaacgttcaaatccgctcccggcggatttgtcctactcaggagagcgttcaccgacaaacaacagataaaacgaaaggcccagtcttccgactgagcctttcgttttatttgatgcctggcagttccctactctcgcgttaacgctagcatggatgttttcccagtcacgacgttgtaaaacgacggccagtcttaagctcgggccccaaataatgattttattttgactgatagtgacctgttcgttgcaacaaattgatgagcaatgcttttttataatgccaactttgtacaaaaaagttggattttttttcgggatggccaccatctctttgactactgagcaacttttagaacacccagaactggttgcaattgatggggtgttgtacgatctcttcggactggcgaaagtgcatccaggtggcaacctcattgaagccgccggtgcctccgacggaaccgccctgttctactccatgcaccctggagtgaagccagagaattcgaagctgctgcagcaatttgcccgaggcaaacacgaacgaagctcgaaggacccagtgtacacctttgacagtcccttcgcccaggatgtcaagcagagcgttcgggaggtcatgaaggggcgcaactggtacgccacgcccggcttttggctgcggaccgcgctgatcatcgcgtgcactgccataggcgaatggtattggatcactaccggggcagtgatgtggggcatcttcaccgggtacttccacagccagattgggttggcgattcaacacgatgcctctcacggagccatcagcaaaaagccctgggtgaacgcctttttcgcctacggcatcgacgccattggatcctcccgctggatctggctgcagtcccacattatgcgccaccacacctacaccaaccagcatggcctggacctggacgctgcctcggcggagccgttcattttgttccactcctacccggcaacaaatgcgtcacgaaagtggtaccatcggttccaggcgtggtacatgtacatcgttttggggatgtatggtgtgtcgatggtgtacaatccgatgtacttgttcacgatgcagcacaacgacacaatcccagaggccacctctcttagaccaggcagctttttcaaccggcagcgcgccttcgccgtttccctccgcctactgttcatcttccgcaacgccttcctcccctggtacatcgcgggcgcctctccgctgctcaccatcctgctggtgccaacggtcacaggcatcttcttgacatttgtttttgtgctgtcccataactttgaaggcgctgagcggacccccgaaaagaactgcaaggccaaaagggccaaggaggggaaggaggtccgcgatgtagaggaggaccgggtggactggtaccgggcgcaggccgagaccgcggcgacctacgggggcagcgtcgggatgatgctgaccggcggtttgaacctgcagatcgagcaccacttgttcccccgcatgtcctcttggcactaccccttcatccaagatacggtgcgggaatgttgcaagcgccatggcgtgcgctacacatactacccgaccatcctggagaatataatgtccacgctccgctacatgcagaaggtgggcgtggcccacacaattcaggatgcccaggaattctgagtgagttcgatccgcatcgacgtctaccatttttgatgctgtctattcctgttttcagtcacctccagcattctcatggctggtgaccactgcccctctaacccattgtgacacaccgccaaagactttgcctcttttttttccctttcttttgtcctcggggtgctttggccggtgtttactcgccttgcagtccccgcaaacgaccgacgtttaagctccgttgttgactgggccgctcgtaaacccatctgcaggttgaggctcccatggagaattgtgatggctgattaggaggtggcggggcatacatgcctcgacactcaaagccgggcggcttctggattcgaaaacgcaaatgggcgctttggaaaaaaaaaaaaaaaaaaaaaaaaaaaaacccaactttctt

SEQ ID NO: 106 - DNA, 1362 bp, Euglena anabaena
atggccaccatctctttgactactgagcaacttttagaacacccagaactggttgcaattgatggggtgttgtacgatctcttcggactggcgaaagtgcatccaggtggcaacctcattgaagccgccggtgcctccgacggaaccgccctgttctactccatgcaccctggagtgaagccagagaattcgaagctgctgcagcaatttgcccgaggcaaacacgaacgaagctcgaaggacccagtgtacacctttgacagtcccttcgcccaggatgtcaagcagagcgttcgggaggtcatgaaggggcgcaactggtacgccacgcccggcttttggctgcggaccgcgctgatcatcgcgtgcactgccataggcgaatggtattggatcactaccggggcagtgatgtggggcatcttcaccgggtacttccacagccagattgggttggcgattcaacacgatgcctctcacggagccatcagcaaaaagccctgggtgaacgcctttttcgcctacggcatcgacgccattggatcctcccgctggatctggctgcagtcccacattatgcgccaccacacctacaccaaccagcatggcctggacctggacgctgcctcggcggagccgttcattttgttccactcctacccggcaacaaatgcgtcacgaaagtggtaccatcggttccaggcgtggtacatgtacatcgttttggggatgtatggtgtgtcgatggtgtacaatccgatgtacttgttcacgatgcagcacaacgacacaatcccagaggccacctctcttagaccaggcagctttttcaaccggcagcgcgccttcgccgtttccctccgcctactgttcatcttccgcaacgccttcctcccctggtacatcgcgggcgcctctccgctgctcaccatcctgctggtgccaacggtcacaggcatcttcttgacatttgtttttgtgctgtcccataactttgaaggcgctgagcggacccccgaaaagaactgcaaggccaaaagggccaaggaggggaaggaggtccgcgatgtagaggaggaccgggtggactggtaccgggcgcaggccgagaccgcggcgacctacgggggcagcgtcgggatgatgctgaccggcggtttgaacctgcagatcgagcaccacttgttcccccgcatgtcctcttggcactaccccttcatccaagatacggtgcgggaatgttgcaagcgccatggcgtgcgctacacatactacccgaccatcctggagaatataatgtccacgctccgctacatgcagaaggtgggcgtggcccacacaattcaggatgcccaggaattc

SEQ ID NO: 107 - protein, 454 aa, Euglena anabaena
MATISLTTEQLLEHPELVAIDGVLYDLFGLAKVHPGGNLIEAAGASDGTALFYSMHPGVKPENSKLLQQFARGKHERSSKDPVYTFDSPFAQDVKQSVREVMKGRNWYATPGFWLRTALIIACTAIGEWYWITTGAVMWGIFTGYFHSQIGLAIQHDASHGAISKKPWVNAFFAYGIDAIGSSRWIWLQSHIMRHHTYTNQHGLDLDAASAEPFILFHSYPATNASRKWYHRFQAWYMYIVLGMYGVSMVYNPMYLFTMQHNDTIPEATSLRPGSFFNRQRAFAVSLRLLFIFRNAFLPWYIAGASPLLTILLVPTVTGIFLTFVFVLSHNFEGAERTPEKNCKAKRAKEGKEVRDVEEDRVDWYRAQAETAATYGGSVGMMLTGGLNLQIEHHLFPRMSSWHYPFIQDTVRECCKRHGVRYTYYPTILENIMSTLRYMQKVGVAHTIQDAQEF

SEQ ID NO: 108 - DNA, 31 bp, Artificial Sequence
  EaD9-5Bbs oligonucleotide
gaagacaccatggaagcagccaaagaattgg

SEQ ID NO: 109 - DNA, 30 bp, Artificial Sequence
  EaD9-3fusion oligonucleotide
agctggacgggcgggctccttcttccctcg

SEQ ID NO: 110 - DNA, 30 bp, Artificial Sequence
  EgDHAsyn1Link-5fusion oligonucleotide
cgagggaagaaggagcccgcccgtccagct

SEQ ID NO: 111 - DNA, 31 bp, Artificial Sequence
  MWG511 oligonucleotide
gaattcgcggccgctcactgccagggagtcg

SEQ ID NO: 112 - DNA, 852 bp, Artificial Sequence
  EgD9elo-EgDHAsyn1Link
gaagacaccatggaagcagccaaagaattggtttccatcgtccaagaggagctccccaaggtggactatgcccagctttggcaggatgccagcagctgtgaggtcctttacctctcggtggcattcgtggcgatcaagttcatgctgcgcccactggacctgaagcgccaggccaccttgaagaagctgttcacagcatacaacttcctcatgtcgatctattcctttggctccttcctggccatggcctatgccctatcagtaactggcatcctctccggcgactgtgagacggcgttcaacaacgatgtgttcaggatcacaactcagctgttctacctcagcaagttcgtagagtacatcgactccttctaccttccccttatggacaagccactgtcgttccttcagttcttccatcatttgggggcccccattgacatgtggctattctacaaataccgcaacgaaggagtctggatctttgtcctgttgaatgggttcattcactggatcatgtacggttactattggacgcggctcatcaagctgaacttccccatgcccaagaacctgatcacctccatgcagatcatccagttcaatgtcgggttctacatcgtctggaagtaccgcaatgtgccatgctaccgccaggatgggatgcgcatgtttgcctggatcttcaactactggtatgtcgggacggtcttgctgctgttcctcaacttttacgtgcagacgtacatccggaagccgaggaagaaccgagggaagaaggagcccgcccgtccagctggactcccgccggccacgtactacgactccctggcagtgagcggccgcgaattc

SEQ ID NO: 113 - DNA, 5559 bp, Artificial Sequence
  pLF124
ggccgcaagtatgaactaaaatgcacgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaactttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaaggaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtaaagcaatggttgaccgtgtgcttagcttcttttattttatttttttatcagcaaagaataaataaaataaaatgagacacttcagggatgtttcaacggatcccccgggctgcaggaattcgatatcaagcttatcgataccgtcgacctcgagggggggcccggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctccaccctagaactagtggatccttcatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactccatggaagcagccaaagaattggtttccatcgtccaagaggagctccccaaggtggactatgcccagctttggcaggatgccagcagctgtgaggtcctttacctctcggtggcattcgtggcgatcaagttcatgctgcgcccactggacctgaagcgccaggccaccttgaagaagctgttcacagcatacaacttcctcatgtcgatctattcctttggctccttcctggccatggcctatgccctatcagtaactggcatcctctccggcgactgtgagacggcgttcaacaacgatgtgttcaggatcacaactcagctgttctacctcagcaagttcgtagagtacatcgactccttctaccttccccttatggacaagccactgtcgttccttcagttcttccatcatttgggggcccccattgacatgtggctattctacaaataccgcaacgaaggagtctggatctttgtcctgttgaatgggttcattcactggatcatgtacggttactattggacgcggctcatcaagctgaacttccccatgcccaagaacctgatcacctccatgcagatcatccagttcaatgtcgggttctacatcgtctggaagtaccgcaatgtgccatgctaccgccaggatgggatgcgcatgtttgcctggatcttcaactactggtatgtcgggacggtcttgctgctgttcctcaacttttacgtgcagacgtacatccggaagccgaggaagaaccgagggaagaaggagcccgcccgtccagctggactcccgccggccacgtactacgactccctggcagtgagc

SEQ ID NO: 114 - DNA, 5213 bp, Artificial Sequence
  KS366
ctagaactagtggatccttcatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactccatggtgagagcgcggttcccattactgttgctgggagttgttttcctagcatcagtttctgtctcatttggcattgcgtattgggaaaagcagaaccccagtcacaacaagtgcctccgaagttgcaatagcgagaaagactcctacaggaaccaagcatgccacgctcgttgcaacctccttaaggtggaggaaatggttgagaaagagaaatgcaaacgcggtaagatcccacgtccacgtcctcgtccacagcacccagaacgtgaaccacagcagccaggtgagaaagaacgtgataaggatcgtcagccacgtccaatcccattccctcgtccacagccacgtcagaaagagaaacatgaacagcgtcgtgaacagaaatggccacgtaaagaagagaaacgcggtgagaaaggttctgaacgtgaaaagaaagacaaagatgaggaacaggatgaacgtcagttcccattcccggtggcggccgcaagtatgaactaaaatgcacgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaactttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaaggaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtaaagcaatggttgaccgtgtgcttagcttcttttattttatttttttatcagcaaagaataaataaaataaaatgagacacttcagggatgtttcaacggatcccccgggctgcaggaattcgatatcaagcttatcgataccgtcgacctcgagggggggcccggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctccacc

SEQ ID NO: 115 - DNA, 5559 bp, Artificial Sequence; identical to SEQ ID NO: 113
  pKR1177

SEQ ID NO: 116 - DNA, 7916 bp, Artificial Sequence
  pKR1179
gatccgtcgacggcgcgcccgatcatccggatatagttcctcctttcagcaaaaaacccctcaagacccgtttagaggccccaaggggttatgctagttattgctcagcggtggcagcagccaactcagcttcctttcgggctttgttagcagccggatcgatccaagctgtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggcttttccatgggtatatctccttcttaaagttaaacaaaattatttctagagggaaaccgttgtggtctccctatagtgagtcgtattaatttcgcgggatcgagatcgatccaattccaatcccacaaaaatctgagcttaacagcacagttgctcctctcagagcagaatcgggtattcaacaccctcatatcaactactacgttgtgtataacggtccacatgccggtatatacgatgactggggttgtacaaaggcggcaacaaacggcgttcccggagttgcacacaagaaatttgccactattacagaggcaagagcagcagctgacgcgtacacaacaagtcagcaaacagacaggttgaacttcatccccaaaggagaagctcaactcaagcccaagagctttgctaaggccctaacaagcccaccaaagcaaaaagcccactggctcacgctaggaaccaaaaggcccagcagtgatccagccccaaaagagatctcctttgccccggagattacaatggacgatttcctctatctttacgatctaggaaggaagttcgaaggtgaaggtgacgacactatgttcaccactgataatgagaaggttagcctcttcaatttcagaaagaatgctgacccacagatggttagagaggcctacgcagcaggtctcatcaagacgatctacccgagtaacaatctccaggagatcaaataccttcccaagaaggttaaagatgcagtcaaaagattcaggactaattgcatcaagaacacagagaaagacatatttctcaagatcagaagtactattccagtatggacgattcaaggcttgcttcataaaccaaggcaagtaatagagattggagtctctaaaaaggtagttcctactgaatctaaggccatgcatggagtctaagattcaaatcgaggatctaacagaactcgccgtgaagactggcgaacagttcatacagagtcttttacgactcaatgacaagaagaaaatcttcgtcaacatggtggagcacgacactctggtctactccaaaaatgtcaaagatacagtctcagaagaccaaagggctattgagacttttcaacaaaggataatttcgggaaacctcctcggattccattgcccagctatctgtcacttcatcgaaaggacagtagaaaaggaaggtggctcctacaaatgccatcattgcgataaaggaaaggctatcattcaagatgcctctgccgacagtggtcccaaagatggacccccacccacgaggagcatcgtggaaaaagaagacgttccaaccacgtcttcaaagcaagtggattgatgtgacatctccactgacgtaagggatgacgcacaatcccactatccttcgcaagacccttcctctatataaggaagttcatttcatttggagaggacacgctcgagctcatttctctattacttcagccataacaaaagaactcttttctcttcttattaaaccatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggccatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacctaaagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgatgtcgaatcgatcaacctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatggacatattgtcgttagaacgcggctacaattaatacataaccttatgtatcatacacatacgatttaggtgacactatagaacggcgcgccaagcttggatctcctgcaggatctggccggccggatctcgtacggatccttcatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactccatggaagcagccaaagaattggtttccatcgtccaagaggagctccccaaggtggactatgcccagctttggcaggatgccagcagctgtgaggtcctttacctctcggtggcattcgtggcgatcaagttcatgctgcgcccactggacctgaagcgccaggccaccttgaagaagctgttcacagcatacaacttcctcatgtcgatctattcctttggctccttcctggccatggcctatgccctatcagtaactggcatcctctccggcgactgtgagacggcgttcaacaacgatgtgttcaggatcacaactcagctgttctacctcagcaagttcgtagagtacatcgactccttctaccttccccttatggacaagccactgtcgttccttcagttcttccatcatttgggggcccccattgacatgtggctattctacaaataccgcaacgaaggagtctggatctttgtcctgttgaatgggttcattcactggatcatgtacggttactattggacgcggctcatcaagctgaacttccccatgcccaagaacctgatcacctccatgcagatcatccagttcaatgtcgggttctacatcgtctggaagtaccgcaatgtgccatgctaccgccaggatgggatgcgcatgtttgcctggatcttcaactactggtatgtcgggacggtcttgctgctgttcctcaacttttacgtgcagacgtacatccggaagccgaggaagaaccgagggaagaaggagcccgcccgtccagctggactcccgccggccacgtactacgactccctggcagtgagcggccgcaagtatgaactaaaatgcacgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaactttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaaggaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtaaagcaatggttgaccgtgtgcttagcttcttttattttatttttttatcagcaaagaataaataaaataaaatgagacacttcagggatgtttcaacg

SEQ ID NO: 117 - DNA, 9190 bp, Artificial Sequence
  pKR1183
ggccgcaagtatgaactaaaatgcacgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaactttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaaggaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtaaagcaatggttgaccgtgtgcttagcttcttttattttatttttttatcagcaaagaataaataaaataaaatgagacacttcagggatgtttcaacggatccgtcgacggcgcgcccgatcatccggatatagttcctcctttcagcaaaaaacccctcaagacccgtttagaggccccaaggggttatgctagttattgctcagcggtggcagcagccaactcagcttcctttcgggctttgttagcagccggatcgatccaagctgtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggcttttccatgggtatatctccttcttaaagttaaacaaaattatttctagagggaaaccgttgtggtctccctatagtgagtcgtattaatttcgcgggatcgagatcgatccaattccaatcccacaaaaatctgagcttaacagcacagttgctcctctcagagcagaatcgggtattcaacaccctcatatcaactactacgttgtgtataacggtccacatgccggtatatacgatgactggggttgtacaaaggcggcaacaaacggcgttcccggagttgcacacaagaaatttgccactattacagaggcaagagcagcagctgacgcgtacacaacaagtcagcaaacagacaggttgaacttcatccccaaaggagaagctcaactcaagcccaagagctttgctaaggccctaacaagcccaccaaagcaaaaagcccactggctcacgctaggaaccaaaaggcccagcagtgatccagccccaaaagagatctcctttgccccggagattacaatggacgatttcctctatctttacgatctaggaaggaagttcgaaggtgaaggtgacgacactatgttcaccactgataatgagaaggttagcctcttcaatttcagaaagaatgctgacccacagatggttagagaggcctacgcagcaggtctcatcaagacgatctacccgagtaacaatctccaggagatcaaataccttcccaagaaggttaaagatgcagtcaaaagattcaggactaattgcatcaagaacacagagaaagacatatttctcaagatcagaagtactattccagtatggacgattcaaggcttgcttcataaaccaaggcaagtaatagagattggagtctctaaaaaggtagttcctactgaatctaaggccatgcatggagtctaagattcaaatcgaggatctaacagaactcgccgtgaagactggcgaacagttcatacagagtcttttacgactcaatgacaagaagaaaatcttcgtcaacatggtggagcacgacactctggtctactccaaaaatgtcaaagatacagtctcagaagaccaaagggctattgagacttttcaacaaaggataatttcgggaaacctcctcggattccattgcccagctatctgtcacttcatcgaaaggacagtagaaaaggaaggtggctcctacaaatgccatcattgcgataaaggaaaggctatcattcaagatgcctctgccgacagtggtcccaaagatggacccccacccacgaggagcatcgtggaaaaagaagacgttccaaccacgtcttcaaagcaagtggattgatgtgacatctccactgacgtaagggatgacgcacaatcccactatccttcgcaagacccttcctctatataaggaagttcatttcatttggagaggacacgctcgagctcatttctctattacttcagccataacaaaagaactcttttctcttcttattaaaccatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggccatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacctaaagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgatgtcgaatcgatcaacctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatggacatattgtcgttagaacgcggctacaattaatacataaccttatgtatcatacacatacgatttaggtgacactatagaacggcgcgccaagcttggatctcctgcaggatctggccggccggatctcgtacggatccttcatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactccatggaagcagccaaagaattggtttccatcgtccaagaggagctccccaaggtggactatgcccagctttggcaggatgccagcagctgtgaggtcctttacctctcggtggcattcgtggcgatcaagttcatgctgcgcccactggacctgaagcgccaggccaccttgaagaagctgttcacagcatacaacttcctcatgtcgatctattcctttggctccttcctggccatggcctatgccctatcagtaactggcatcctctccggcgactgtgagacggcgttcaacaacgatgtgttcaggatcacaactcagctgttctacctcagcaagttcgtagagtacatcgactccttctaccttccccttatggacaagccactgtcgttccttcagttcttccatcatttgggggcccccattgacatgtggctattctacaaataccgcaacgaaggagtctggatctttgtcctgttgaatgggttcattcactggatcatgtacggttactattggacgcggctcatcaagctgaacttccccatgcccaagaacctgatcacctccatgcagatcatccagttcaatgtcgggttctacatcgtctggaagtaccgcaatgtgccatgctaccgccaggatgggatgcgcatgtttgcctggatcttcaactactggtatgtcgggacggtcttgctgctgttcctcaacttttacgtgcagacgtacatccggaagccgaggaagaaccgagggaagaaggagcccgcccgtccagctggactcccgccggccacgtactacgactccctggcagtgagcggccgcaccatgtctcctaagcggcaagctctgccaatcacaattgatggcgcaacttatgatgtgtctgcttgggtcaatcaccaccctggaggagctgacattatcgagaactatcgcaaccgcgatgcgaccgatgtcttcatggtgatgcactctcaagaagccgtcgccaagttgaagagaatgcctgttatggagccttcctctcctgacacacctgttgcacccaagcctaagcgtgatgagccccaggaggatttccgcaagttgcgggaggaattcatctccaagggtatgttcgagacgagtttcctttggtatttttacaagacttcaactaccgtcggtttgatggtcctttccatcttgatgaccgtgtacacgaattggtatttcaccgctgctttggttcttggcgtgtgctaccaacagctaggctggttgtcccacgactattgccatcaccaggttttcacaaaccgcaagattaacgacgctttcggtctctttttcggtaacgtgatgcagggatactcacagacttggtggaaggataggcacaatggtcaccatgccgccaccaatgtggtcggccatgacccagatattgataacctccccatcctggcttggtctcccgaagatgtcaagagggctactccttcgactcggaatctcatcaagtaccagcagtactacttcattcccaccattgcatcccttaggttcatctggtgcctccaatccatcggcggcgtcatgtcctacaagagcgaggagaggaacctgtactacaagcgccagtacactaaggaggcgattggtctggccctccactgggtgctcaaggccactttctattgcagtgccatgcctagctttgccaccggtttgggatgcttcttgatctccgagctgctcggaggatttggcattgccatcgttgtgtttctgaatcactatcctttggacaaggttgaggagactgtctgggatgagcacgggttcagcgccagccagatccacgagacgttgaacattaagcccggccttctcaccgattgggtctttggtggtctcaactaccagattgagcaccacttgtggcccaacatgcccaggcacaacctcacggcagcttccctggaggtgcagaagttgtgcgccaagcacaacctgccctacagggccccagccatcatccccggggttcagaaattggtcagcttcttaggcgagattgcccagctggctgctgtccctgaatgagc

SEQ ID NO: 118 - DNA, 6615 bp, Artificial Sequence
  pKR1237
  misc_feature (4340)..(4340): n is a, c, g, or t
ggccgcgacacaagtgtgagagtactaaataaatgctttggttgtacgaaatcattacactaaataaaataatcaaagcttatatatgccttccgctaaggccgaatgcaaagaaattggttctttctcgttatcttttgccacttttactagtacgtattaattactacttaatcatctttgtttacggctcattatatccggtctagaggatccaaggccgcgaagttaaaagcaatgttgtcacttgtcgtactaacacatgatgtgatagtttatgctagctagctataacataagctgtctctgagtgtgttgtatattaataaagatcatcactggtgaatggtgatcgtgtacgtaccctacttagtaggcaatggaagcacttagagtgtgctttgtgcatggccttgcctctgttttgagacttttgtaatgttttcgagtttaaatctttgcctttgcgtacgtgggcggatcccccgggctgcaggaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttgcatgcctgcaggtcgactcgacgtacgtcctcgaagagaagggttaataacacattttttaacatttttaacacaaattttagttatttaaaaatttattaaaaaatttaaaataagaagaggaactctttaaataaatctaacttacaaaatttatgatttttaataagttttcaccaataaaaaatgtcataaaaatatgttaaaaagtatattatcaatattctctttatgataaataaaaagaaaaaaaaaataaaagttaagtgaaaatgagattgaagtgactttaggtgtgtataaatatatcaaccccgccaacaatttatttaatccaaatatattgaagtatattattccatagcctttatttatttatatatttattatataaaagctttatttgttctaggttgttcatgaaatatttttttggttttatctccgttgtaagaaaatcatgtgctttgtgtcgccactcactattgcagctttttcatgcattggtcagattgacggttgattgtatttttgttttttatggttttgtgttatgacttaagtcttcatctctttatctcttcatcaggtttgatggttacctaatatggtccatgggtacatgcatggttaaattaggtggccaactttgttgtgaacgatagaattttttttatattaagtaaactatttttatattatgaaataataataaaaaaaatattttatcattattaacaaaatcatattagttaatttgttaactctataataaaagaaatactgtaacattcacattacatggtaacatctttccaccctttcatttgttttttgtttgatgactttttttcttgtttaaatttatttcccttcttttaaatttggaatacattatcatcatatataaactaaaatactaaaaacaggattacacaaatgataaataataacacaaatatttataaatctagctgcaatatatttaaactagctatatcgatattgtaaaataaaactagctgcattgatactgataaaaaaatatcatgtgctttctggactgatgatgcagtatacttttgacattgcctttattttatttttcagaaaagctttcttagttctgggttcttcattatttgtttcccatctccattgtgaattgaatcatttgcttcgtgtcacaaatacaatttagntaggtacatgcattggtcagattcacggtttattatgtcatgacttaagttcatggtagtacattacctgccacgcatgcattatattggttagatttgataggcaaatttggttgtcaacaatataaatataaataatgtttttatattacgaaataacagtgatcaaaacaaacagttttatctttattaacaagattttgtttttgtttgatgacgttttttaatgtttacgctttcccccttcttttgaatttagaacactttatcatcataaaatcaaatactaaaaaaattacatatttcataaataataacacaaatatttttaaaaaatctgaaataataatgaacaatattacatattatcacgaaaattcattaataaaaatattatataaataaaatgtaatagtagttatatgtaggaaaaaagtactgcacgcataatatatacaaaaagattaaaatgaactattataaataataacactaaattaatggtgaatcatatcaaaataatgaaaaagtaaataaaatttgtaattaacttctatatgtattacacacacaaataataaataatagtaaaaaaaattatgataaatatttaccatctcataagatatttaaaataatgataaaaatatagattattttttatgcaactagctagccaaaaagagaacacgggtatatataaaaagagtacctttaaattctactgtacttcctttattcctgacgtttttatatcaagtggacatacgtgaagattttaattatcagtctaaatatttcattagcacttaatacttttctgttttattcctatcctataagtagtcccgattctcccaacattgcttattcacacaactaactaagaaagtcttccatagccccccaagcggccgcaaaccatggctctcagtcttaccacagaacagctgttagaacgccctgatttggttgcgattgatggcatcctctacgaccttgaagggcttgccaaagttcatccaggaggagatttgattctcgcttctggtgcctctgatgcctcccctctcttttattcaatgcatccatacgtcaaaccggagaattccaaattgcttcaacagttcgtccgagggaagcatgaccgcacctcgaaggacattgtctacacgtatgattctcccttcgcacaagacgttaagcggacaatgcgcgaggtgatgaaagggaggaactggtacgcaacccctggcttctggctgcgcaccgttgggatcatcgccgtgacggccttttgcgagtggcactgggctaccacggggatggtgctgtggggcctgttgactggattcatgcacatgcagatcggcttatccatccagcatgatgcgtcccacggggccatcagcaagaagccttgggtcaacgccctcttcgcctacggcattgacgtcatcggatcgtcccggtggatttggctgcagtcgcacatcatgcggcaccacacctacaccaaccagcacggcctcgacctggatgcggagtcggcagagccgttcctggtgttccacaactaccccgccgcaaacaccgcccgaaagtggttccaccgcttccaagcttggtacatgtaccttgtgctgggggcatacggggtatcgctggtgtacaacccgctctacattttccggatgcagcacaatgacaccatcccagagtctgtcacggccatgcgggaaaatggctttctgcggcgctaccgcacacttgcattcgtgatgcgagctttcttcatcttccggaccgcattcttgccctggtacctcactgggacctcattgctgatcaccattcctctggtgcccaccgcaactggtgccttcttgacgttcttcttcattttgtcccacaattttgatggctccgaacggatccccgacaagaactgcaaggttaagagatctgagaaggacgttgaggctgaccaaattgactggtatcgggcgcaggtggagacgtcctccacatacggtggccccatcgccatgttcttcactggcggtctcaatttccagatcgagcaccacctctttccccggatgtcgtcttggcactaccccttcgtccagcaggcggtccgggagtgttgcgaacgccatggagtgcgatatgttttctaccctaccatcgtcggcaacatcatctccaccctgaagtacatgcataaggtgggtgtcgtccactgcgtgaaggacgcacaggattcctaagc

SEQ ID NO: 119 - DNA, 6464 bp, Artificial Sequence
  pKR1252
cgcgcccgatcatccggatatagttcctcctttcagcaaaaaacccctcaagacccgtttagaggccccaaggggttatgctagttattgctcagcggtggcagcagccaactcagcttcctttcgggctttgttagcagccggatcgatccaagctgtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggcttttccatgggtatatctccttcttaaagttaaacaaaattatttctagagggaaaccgttgtggtctccctatagtgagtcgtattaatttcgcgggatcgagatctgatcaacctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatggacatattgtcgttagaacgcggctacaattaatacataaccttatgtatcatacacatacgatttaggtgacactatagaacggcgcgccaagcttggatctcctgcaggatctggccggccggatctcgtacggatccttcatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactccatggaagcagccaaagaattggtttccatcgtccaagaggagctccccaaggtggactatgcccagctttggcaggatgccagcagctgtgaggtcctttacctctcggtggcattcgtggcgatcaagttcatgctgcgcccactggacctgaagcgccaggccaccttgaagaagctgttcacagcatacaacttcctcatgtcgatctattcctttggctccttcctggccatggcctatgccctatcagtaactggcatcctctccggcgactgtgagacggcgttcaacaacgatgtgttcaggatcacaactcagctgttctacctcagcaagttcgtagagtacatcgactccttctaccttccccttatggacaagccactgtcgttccttcagttcttccatcatttgggggcccccattgacatgtggctattctacaaataccgcaacgaaggagtctggatctttgtcctgttgaatgggttcattcactggatcatgtacggttactattggacgcggctcatcaagctgaacttccccatgcccaagaacctgatcacctccatgcagatcatccagttcaatgtcgggttctacatcgtctggaagtaccgcaatgtgccatgctaccgccaggatgggatgcgcatgtttgcctggatcttcaactactggtatgtcgggacggtcttgctgctgttcctcaacttttacgtgcagacgtacatccggaagccgaggaagaaccgagggaagaaggagcccgcccgtccagctggactcccgccggccacgtactacgactccctggcagtgagcggccgcaccatgtctcctaagcggcaagctctgccaatcacaattgatggcgcaacttatgatgtgtctgcttgggtcaatcaccaccctggaggagctgacattatcgagaactatcgcaaccgcgatgcgaccgatgtcttcatggtgatgcactctcaagaagccgtcgccaagttgaagagaatgcctgttatggagccttcctctcctgacacacctgttgcacccaagcctaagcgtgatgagccccaggaggatttccgcaagttgcgggaggaattcatctccaagggtatgttcgagacgagtttcctttggtatttttacaagacttcaactaccgtcggtttgatggtcctttccatcttgatgaccgtgtacacgaattggtatttcaccgctgctttggttcttggcgtgtgctaccaacagctaggctggttgtcccacgactattgccatcaccaggttttcacaaaccgcaagattaacgacgctttcggtctctttttcggtaacgtgatgcagggatactcacagacttggtggaaggataggcacaatggtcaccatgccgccaccaatgtggtcggccatgacccagatattgataacctccccatcctggcttggtctcccgaagatgtcaagagggctactccttcgactcggaatctcatcaagtaccagcagtactacttcattcccaccattgcatcccttaggttcatctggtgcctccaatccatcggcggcgtcatgtcctacaagagcgaggagaggaacctgtactacaagcgccagtacactaaggaggcgattggtctggccctccactgggtgctcaaggccactttctattgcagtgccatgcctagctttgccaccggtttgggatgcttcttgatctccgagctgctcggaggatttggcattgccatcgttgtgtttctgaatcactatcctttggacaaggttgaggagactgtctgggatgagcacgggttcagcgccagccagatccacgagacgttgaacattaagcccggccttctcaccgattgggtctttggtggtctcaactaccagattgagcaccacttgtggcccaacatgcccaggcacaacctcacggcagcttccctggaggtgcagaagttgtgcgccaagcacaacctgccctacagggccccagccatcatccccggggttcagaaattggtcagcttcttaggcgagattgcccagctggctgctgtccctgaatgagcggccgcaagtatgaactaaaatgcacgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaactttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaaggaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtaaagcaatggttgaccgtgtgcttagcttcttttattttatttttttatcagcaaagaataaataaaataaaatgagacacttcagggatgtttcaacggatccgtcgacgg

SEQ ID NO: 120 - DNA, 10387 bp, Artificial Sequence
  pKR1253
  misc_feature (9212)..(9212): n is a, c, g, or t
gtacggatccttcatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactccatggaagcagccaaagaattggtttccatcgtccaagaggagctccccaaggtggactatgcccagctttggcaggatgccagcagctgtgaggtcctttacctctcggtggcattcgtggcgatcaagttcatgctgcgcccactggacctgaagcgccaggccaccttgaagaagctgttcacagcatacaacttcctcatgtcgatctattcctttggctccttcctggccatggcctatgccctatcagtaactggcatcctctccggcgactgtgagacggcgttcaacaacgatgtgttcaggatcacaactcagctgttctacctcagcaagttcgtagagtacatcgactccttctaccttccccttatggacaagccactgtcgttccttcagttcttccatcatttgggggcccccattgacatgtggctattctacaaataccgcaacgaaggagtctggatctttgtcctgttgaatgggttcattcactggatcatgtacggttactattggacgcggctcatcaagctgaacttccccatgcccaagaacctgatcacctccatgcagatcatccagttcaatgtcgggttctacatcgtctggaagtaccgcaatgtgccatgctaccgccaggatgggatgcgcatgtttgcctggatcttcaactactggtatgtcgggacggtcttgctgctgttcctcaacttttacgtgcagacgtacatccggaagccgaggaagaaccgagggaagaaggagcccgcccgtccagctggactcccgccggccacgtactacgactccctggcagtgagcggccgcaccatgtctcctaagcggcaagctctgccaatcacaattgatggcgcaacttatgatgtgtctgcttgggtcaatcaccaccctggaggagctgacattatcgagaactatcgcaaccgcgatgcgaccgatgtcttcatggtgatgcactctcaagaagccgtcgccaagttgaagagaatgcctgttatggagccttcctctcctgacacacctgttgcacccaagcctaagcgtgatgagccccaggaggatttccgcaagttgcgggaggaattcatctccaagggtatgttcgagacgagtttcctttggtatttttacaagacttcaactaccgtcggtttgatggtcctttccatcttgatgaccgtgtacacgaattggtatttcaccgctgctttggttcttggcgtgtgctaccaacagctaggctggttgtcccacgactattgccatcaccaggttttcacaaaccgcaagattaacgacgctttcggtctctttttcggtaacgtgatgcagggatactcacagacttggtggaaggataggcacaatggtcaccatgccgccaccaatgtggtcggccatgacccagatattgataacctccccatcctggcttggtctcccgaagatgtcaagagggctactccttcgactcggaatctcatcaagtaccagcagtactacttcattcccaccattgcatcccttaggttcatctggtgcctccaatccatcggcggcgtcatgtcctacaagagcgaggagaggaacctgtactacaagcgccagtacactaaggaggcgattggtctggccctccactgggtgctcaaggccactttctattgcagtgccatgcctagctttgccaccggtttgggatgcttcttgatctccgagctgctcggaggatttggcattgccatcgttgtgtttctgaatcactatcctttggacaaggttgaggagactgtctgggatgagcacgggttcagcgccagccagatccacgagacgttgaacattaagcccggccttctcaccgattgggtctttggtggtctcaactaccagattgagcaccacttgtggcccaacatgcccaggcacaacctcacggcagcttccctggaggtgcagaagttgtgcgccaagcacaacctgccctacagggccccagccatcatccccggggttcagaaattggtcagcttcttaggcgagattgcccagctggctgctgtccctgaatgagcggccgcaagtatgaactaaaatgcacgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaactttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaaggaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtaaagcaatggttgaccgtgtgcttagcttcttttattttatttttttatcagcaaagaataaataaaataaaatgagacacttcagggatgtttcaacggatccgtcgacggcgcgcccgatcatccggatatagttcctcctttcagcaaaaaacccctcaagacccgtttagaggccccaaggggttatgctagttattgctcagcggtggcagcagccaactcagcttcctttcgggctttgttagcagccggatcgatccaagctgtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggcttttccatgggtatatctccttcttaaagttaaacaaaattatttctagagggaaaccgttgtggtctccctatagtgagtcgtattaatttcgcgggatcgagatctgatcaacctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatggacatattgtcgttagaacgcggctacaattaatacataaccttatgtatcatacacatacgatttaggtgacactatagaacggcgcgccaagcttggatctcctgcaggatctggccggccggatctcgtacgcaaaggcaaagatttaaactcgaaaacattacaaaagtctcaaaacagaggcaaggccatgcacaaagcacactctaagtgcttccattgcctactaagtagggtacgtacacgatcaccattcaccagtgatgatctttattaatatacaacacactcagagacagcttatgttatagctagctagcataaactatcacatcatgtgttagtacgacaagtgacaacattgcttttaacttcgcggccttggatcctctagaccggatataatgagccgtaaacaaagatgattaagtagtaattaatacgtactagtaaaagtggcaaaagataacgagaaagaaccaatttctttgcattcggccttagcggaaggcatatataagctttgattattttatttagtgtaatgatttcgtacaaccaaagcatttatttagtactctcacacttgtgtcgcggccgcttaggaatcctgtgcgtccttcacgcagtggacgacacccaccttatgcatgtacttcagggtggagatgatgttgccgacgatggtagggtagaaaacatatcgcactccatggcgttcgcaacactcccggaccgcctgctggacgaaggggtagtgccaagacgacatccggggaaagaggtggtgctcgatctggaaattgagaccgccagtgaagaacatggcgatggggccaccgtatgtggaggacgtctccacctgcgcccgataccagtcaatttggtcagcctcaacgtccttctcagatctcttaaccttgcagttcttgtcggggatccgttcggagccatcaaaattgtgggacaaaatgaagaagaacgtcaagaaggcaccagttgcggtgggcaccagaggaatggtgatcagcaatgaggtcccagtgaggtaccagggcaagaatgcggtccggaagatgaagaaagctcgcatcacgaatgcaagtgtgcggtagcgccgcagaaagccattttcccgcatggccgtgacagactctgggatggtgtcattgtgctgcatccggaaaatgtagagcgggttgtacaccagcgataccccgtatgcccccagcacaaggtacatgtaccaagcttggaagcggtggaaccactttcgggcggtgtttgcggcggggtagttgtggaacaccaggaacggctctgccgactccgcatccaggtcgaggccgtgctggttggtgtaggtgtggtgccgcatgatgtgcgactgcagccaaatccaccgggacgatccgatgacgtcaatgccgtaggcgaagagggcgttgacccaaggcttcttgctgatggccccgtgggacgcatcatgctggatggataagccgatctgcatgtgcatgaatccagtcaacaggccccacagcaccatccccgtggtagcccagtgccactcgcaaaaggccgtcacggcgatgatcccaacggtgcgcagccagaagccaggggttgcgtaccagttcctccctttcatcacctcgcgcattgtccgcttaacgtcttgtgcgaagggagaatcatacgtgtagacaatgtccttcgaggtgcggtcatgcttccctcggacgaactgttgaagcaatttggaattctccggtttgacgtatggatgcattgaataaaagagaggggaggcatcagaggcaccagaagcgagaatcaaatctcctcctggatgaactttggcaagcccttcaaggtcgtagaggatgccatcaatcgcaaccaaatcagggcgttctaacagctgttctgtggtaagactgagagccatggtttgcggccgcttggggggctatggaagactttcttagttagttgtgtgaataagcaatgttgggagaatcgggactacttataggataggaataaaacagaaaagtattaagtgctaatgaaatatttagactgataattaaaatcttcacgtatgtccacttgatataaaaacgtcaggaataaaggaagtacagtagaatttaaaggtactctttttatatatacccgtgttctctttttggctagctagttgcataaaaaataatctatatttttatcattattttaaatatcttatgagatggtaaatatttatcataattttttttactattatttattatttgtgtgtgtaatacatatagaagttaattacaaattttatttactttttcattattttgatatgattcaccattaatttagtgttattatttataatagttcattttaatctttttgtatatattatgcgtgcagtacttttttcctacatataactactattacattttatttatataatatttttattaatgaattttcgtgataatatgtaatattgttcattattatttcagattttttaaaaatatttgtgttattatttatgaaatatgtaatttttttagtatttgattttatgatgataaagtgttctaaattcaaaagaagggggaaagcgtaaacattaaaaaacgtcatcaaacaaaaacaaaatcttgttaataaagataaaactgtttgttttgatcactgttatttcgtaatataaaaacattatttatatttatattgttgacaaccaaatttgcctatcaaatctaaccaatataatgcatgcgtggcaggtaatgtactaccatgaacttaagtcatgacataataaaccgtgaatctgaccaatgcatgtacctanctaaattgtatttgtgacacgaagcaaatgattcaattcacaatggagatgggaaacaaataatgaagaacccagaactaagaaagcttttctgaaaaataaaataaaggcaatgtcaaaagtatactgcatcatcagtccagaaagcacatgatatttttttatcagtatcaatgcagctagttttattttacaatatcgatatagctagtttaaatatattgcagctagatttataaatatttgtgttattatttatcatttgtgtaatcctgtttttagtattttagtttatatatgatgataatgtattccaaatttaaaagaagggaaataaatttaaacaagaaaaaaagtcatcaaacaaaaaacaaatgaaagggtggaaagatgttaccatgtaatgtgaatgttacagtatttcttttattatagagttaacaaattaactaatatgattttgttaataatgataaaatattttttttattattatttcataatataaaaatagtttacttaatataaaaaaaattctatcgttcacaacaaagttggccacctaatttaaccatgcatgtacccatggaccatattaggtaaccatcaaacctgatgaagagataaagagatgaagacttaagtcataacacaaaaccataaaaaacaaaaatacaatcaaccgtcaatctgaccaatgcatgaaaaagctgcaatagtgagtggcgacacaaagcacatgattttcttacaacggagataaaaccaaaaaaatatttcatgaacaacctagaacaaataaagcttttatataataaatatataaataaataaaggctatggaataatatacttcaatatatttggattaaataaattgttggcggggttgatatatttatacacacctaaagtcacttcaatctcattttcacttaacttttattttttttttctttttatttatcataaagagaatattgataatatactttttaacatatttttatgacattttttattggtgaaaacttattaaaaatcataaattttgtaagttagatttatttaaagagttcctcttcttattttaaattttttaataaatttttaaataactaaaatttgtgttaaaaatgttaaaaaatgtgttattaacccttctcttcgaggac

SEQ ID NO: 121 - DNA, 30 bp, Artificial Sequence
  oligonucleotide oEAd5-1-1
agcggccgcaccatggccaccatctctttg

SEQ ID NO: 122 - DNA, 30 bp, Artificial Sequence
  oligonucleotide oEAd5-1-1
tgcggccgctcagaattcctgggcatcctg

SEQ ID NO: 123 - DNA, 4899 bp, Artificial Sequence
  pKR1136
aattccagcacactggcggccgttactagtggatccgagctcggtaccaagcttgatgcatagcttgagtattctaacgcgtcacctaaatagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaagcccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttagcacgtgtcagtcctgctcctcggccacgaagtgcacgcagttgccggccgggtcgcgcagggcgaactcccgcccccacggctgctcgccgatctcggtcatggccggcccggaggcgtcccggaagttcgtggacacgacctccgaccactcggcgtacagctcgtccaggccgcgcacccacacccaggccagggtgttgtccggcaccacctggtcctggaccgcgctgatgaacagggtcacgtcgtcccggaccacaccggcgaagtcgtcctccacgaagtcccgggagaacccgagccggtcggtccagaactcgaccgctccggcgacgtcgcgcgcggtgagcaccggaacggcactggtcaacttggccatggtggccctcctcacgtgctattattgaagcatttatcagggttattgtctcatgagcggatacatatttgaatgtatttagaaaaataaacaaataggggttccgcgcacatttccccgaaaagtgccacctgtatgcggtgtgaaataccgcacagatgcgtaaggagaaaataccgcatcaggaaattgtaagcgttaataattcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcctcgccgtcgggcatgctcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcttgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatcctcatcctgtctcttgatcagagcttgatcccctgcgccatcagatccttggcggcgagaaagccatccagtttactttgcagggcttcccaaccttaccagagggcgccccagctggcaattccggttcgcttgctgtccataaaaccgcccagtctagctatcgccatgtaagcccactgcaagctacctgctttctctttgcgcttgcgttttcccttgtccagatagcccagtagctgacattcatccggggtcagcaccgtttctgcggactggctttctacgtgaaaaggatctaggtgaagatcctttttgataatctcatgcctgacatttatattccccagaacatcaggttaatggcgtttttgatgtcattttcgcggtggctgagatcagccacttcttccccgataacggagaccggcacactggccatatcggtggtcatcatgcgccagctttcatccccgatatgcaccaccgggtaaagttcacgggagactttatctgacagcagacgtgcactggccagggggatcaccatccgtcgccccggcgtgtcaataatatcactctgtacatccacaaacagacgataacggctctctcttttataggtgtaaaccttaaactgccgtacgtataggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggccctctagatgcatgctcgagcggccgccagtgtgatggatatctgcagaattcaggagcggccgcaccatggccaccatctctttgactactgagcaacttttagaacacccagaactggttgcaattgatggggtgttgtacgatctcttcggactggcgaaagtgcatccaggtggcaacctcattgaagccgccggtgcctccgacggaaccgccctgttctactccatgcaccctggagtgaagccagagaattcgaagctgctgcagcaatttgcccgaggcaaacacgaacgaagctcgaaggacccagtgtacacctttgacagtcccttcgcccaggatgtcaagcagagcgttcgggaggtcatgaaggggcgcaactggtacgccacgcccggcttttggctgcggaccgcgctgatcatcgcgtgcactgccataggcgaatggtattggatcactaccggggcagtgatgtggggcatcttcaccgggtacttccacagccagattgggttggcgattcaacacgatgcctctcacggagccatcagcaaaaagccctgggtgaacgcctttttcgcctacggcatcgacgccattggatcctcccgctggatctggctgcagtcccacattatgcgccaccacacctacaccaaccagcatggcctggacctggacgctgcctcggcggagccgttcattttgttccactcctacccggcaacaaatgcgtcacgaaagtggtaccatcggttccaggcgtggtacatgtacatcgttttggggatgtatggtgtgtcgatggtgtacaatccgatgtacttgttcacgatgcagcacaacgacacaatcccagaggccacctctcttagaccaggcagctttttcaaccggcagcgcgccttcgccgtttccctccgcctactgttcatcttccgcaacgccttcctcccctggtacatcgcgggcgcctctccgctgctcaccatcctgctggtgccaacggtcacaggcatcttcttgacatttgtttttgtgctgtcccataactttgaaggcgctgagcggacccccgaaaagaactgcaaggccaaaagggccaaggaggggaaggaggtccgcgatgtagaggaggaccgggtggactggtaccgggcgcaggccgagaccgcggcgacctacgggggcagcgtcgggatgatgctgaccggcggtttgaacctgcagatcgagcaccacttgttcccccgcatgtcctcttggcactaccccttcatccaagatacggtgcgggaatgttgcaagcgccatggcgtgcgctacacatactacccgaccatcctggagaatataatgtccacgctccgctacatgcagaaggtgggcgtggcccacacaattcaggatgcccaggaattctgagcggccgcacctg

SEQ ID NO: 124 - DNA, 5592 bp, Artificial Sequence
  pKR1139
ggccgcatttcgcaccaaatcaatgaaagtaataatgaaaagtctgaataagaatacttaggcttagatgcctttgttacttgtgtaaaataacttgagtcatgtacctttggcggaaacagaataaataaaaggtgaaattccaatgctctatgtataagttagtaatacttaatgtgttctacggttgtttcaatatcatcaaactctaattgaaactttagaaccacaaatctcaatcttttcttaatgaaatgaaaaatcttaattgtaccatgtttatgttaaacaccttacaattaattggttggagaggaggaccaaccgatgggacaacattgggagaaagagattcaatggagatttggataggagaacaacattctttttcacttcaatacaagatgagtgcaacactaaggatatgtatgagactttcagaagctacgacaacatagatgagtgaggtggtgattcctagcaagaaagacattagaggaagccaaaatcgaacaaggaagacatcaagggcaagagacaggaccatccatctcaggaaaaggagctttgggatagtccgagaagttgtacaagaaattttttggagggtgagtgatgcattgctggtgactttaactcaatcaaaattgagaaagaaagaaaagggagggggctcacatgtgaatagaagggaaacgggagaattttacagttttgatctaatgggcatcccagctagtggtaacatattcaccatgtttaaccttcacgtacgtctagaggatcccccatggtcaatcaatgagacgccaacttcttaatctattgagacctgcaggtctagaagggcggatccccgggtaccgagctcgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttgcatgcctgcaggctagcctaagtacgtactcaaaatgccaacaaataaaaaaaaagttgctttaataatgccaaaacaaattaataaaacacttacaacaccggattttttttaattaaaatgtgccatttaggataaatagttaatatttttaataattatttaaaaagccgtatctactaaaatgatttttatttggttgaaaatattaatatgtttaaatcaacacaatctatcaaaattaaactaaaaaaaaaataagtgtacgtggttaacattagtacagtaatataagaggaaaatgagaaattaagaaattgaaagcgagtctaatttttaaattatgaacctgcatatataaaaggaaagaaagaatccaggaagaaaagaaatgaaaccatgcatggtcccctcgtcatcacgagtttctgccatttgcaatagaaacactgaaacacctttctctttgtcacttaattgagatgccgaagccacctcacaccatgaacttcatgaggtgtagcacccaaggcttccatagccatgcatactgaagaatgtctcaagctcagcaccctacttctgtgacgtgtccctcattcaccttcctctcttccctataaataaccacgcctcaggttctccgcttcacaactcaaacattctctccattggtccttaaacactcatcagtcatcaccgcggccgcaccatggccaccatctctttgactactgagcaacttttagaacacccagaactggttgcaattgatggggtgttgtacgatctcttcggactggcgaaagtgcatccaggtggcaacctcattgaagccgccggtgcctccgacggaaccgccctgttctactccatgcaccctggagtgaagccagagaattcgaagctgctgcagcaatttgcccgaggcaaacacgaacgaagctcgaaggacccagtgtacacctttgacagtcccttcgcccaggatgtcaagcagagcgttcgggaggtcatgaaggggcgcaactggtacgccacgcccggcttttggctgcggaccgcgctgatcatcgcgtgcactgccataggcgaatggtattggatcactaccggggcagtgatgtggggcatcttcaccgggtacttccacagccagattgggttggcgattcaacacgatgcctctcacggagccatcagcaaaaagccctgggtgaacgcctttttcgcctacggcatcgacgccattggatcctcccgctggatctggctgcagtcccacattatgcgccaccacacctacaccaaccagcatggcctggacctggacgctgcctcggcggagccgttcattttgttccactcctacccggcaacaaatgcgtcacgaaagtggtaccatcggttccaggcgtggtacatgtacatcgttttggggatgtatggtgtgtcgatggtgtacaatccgatgtacttgttcacgatgcagcacaacgacacaatcccagaggccacctctcttagaccaggcagctttttcaaccggcagcgcgccttcgccgtttccctccgcctactgttcatcttccgcaacgccttcctcccctggtacatcgcgggcgcctctccgctgctcaccatcctgctggtgccaacggtcacaggcatcttcttgacatttgtttttgtgctgtcccataactttgaaggcgctgagcggacccccgaaaagaactgcaaggccaaaagggccaaggaggggaaggaggtccgcgatgtagaggaggaccgggtggactggtaccgggcgcaggccgagaccgcggcgacctacgggggcagcgtcgggatgatgctgaccggcggtttgaacctgcagatcgagcaccacttgttcccccgcatgtcctcttggcactaccccttcatccaagatacggtgcgggaatgttgcaagcgccatggcgtgcgctacacatactacccgaccatcctggagaatataatgtccacgctccgctacatgcagaaggtgggcgtggcccacacaattcaggatgcccaggaattctgagc

SEQ ID NO: 125 - DNA, 7497 bp, Artificial Sequence
  pKR561
gtacgtcgagtcgacggcgcgcccgatcatccggatatagttcctcctttcagcaaaaaacccctcaagacccgtttagaggccccaaggggttatgctagttattgctcagcggtggcagcagccaactcagcttcctttcgggctttgttagcagccggatcgatccaagctgtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggcttttccatgggtatatctccttcttaaagttaaacaaaattatttctagagggaaaccgttgtggtctccctatagtgagtcgtattaatttcgcgggatcgagatcgatccaattccaatcccacaaaaatctgagcttaacagcacagttgctcctctcagagcagaatcgggtattcaacaccctcatatcaactactacgttgtgtataacggtccacatgccggtatatacgatgactggggttgtacaaaggcggcaacaaacggcgttcccggagttgcacacaagaaatttgccactattacagaggcaagagcagcagctgacgcgtacacaacaagtcagcaaacagacaggttgaacttcatccccaaaggagaagctcaactcaagcccaagagctttgctaaggccctaacaagcccaccaaagcaaaaagcccactggctcacgctaggaaccaaaaggcccagcagtgatccagccccaaaagagatctcctttgccccggagattacaatggacgatttcctctatctttacgatctaggaaggaagttcgaaggtgaaggtgacgacactatgttcaccactgataatgagaaggttagcctcttcaatttcagaaagaatgctgacccacagatggttagagaggcctacgcagcaggtctcatcaagacgatctacccgagtaacaatctccaggagatcaaataccttcccaagaaggttaaagatgcagtcaaaagattcaggactaattgcatcaagaacacagagaaagacatatttctcaagatcagaagtactattccagtatggacgattcaaggcttgcttcataaaccaaggcaagtaatagagattggagtctctaaaaaggtagttcctactgaatctaaggccatgcatggagtctaagattcaaatcgaggatctaacagaactcgccgtgaagactggcgaacagttcatacagagtcttttacgactcaatgacaagaagaaaatcttcgtcaacatggtggagcacgacactctggtctactccaaaaatgtcaaagatacagtctcagaagaccaaagggctattgagacttttcaacaaaggataatttcgggaaacctcctcggattccattgcccagctatctgtcacttcatcgaaaggacagtagaaaaggaaggtggctcctacaaatgccatcattgcgataaaggaaaggctatcattcaagatgcctctgccgacagtggtcccaaagatggacccccacccacgaggagcatcgtggaaaaagaagacgttccaaccacgtcttcaaagcaagtggattgatgtgacatctccactgacgtaagggatgacgcacaatcccactatccttcgcaagacccttcctctatataaggaagttcatttcatttggagaggacacgctcgagctcatttctctattacttcagccataacaaaagaactcttttctcttcttattaaaccatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggccatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacctaaagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgatgtcgaatctgatcaacctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatggacatattgtcgttagaacgcggctacaattaatacataaccttatgtatcatacacatacgatttaggtgacactatagaacggcgcgccaagcttggatcctctagacgtacggtaccatctgctaatattttaaatcacatgcaagagaggaggcatggttccattttctaccttcacattatttgagaaaaacgaacttgttctgtgttttatttttgcccttcacattagtacaacgtggaagactcatggttacacagaatcatacataagtacaatgcttgtccctaagaaaacaagcactcgttgtattgaacctttacggctcatgcggccgctgaagtattgcttcttagttaacctttcctttctctctcagctatgtgaattcattttgctttcgtcacaatttatatagtgaaattggatctttggagttaacgccttcacaggattatcgtgttagaacaatgctttttcatgttctaattagtagtacattacaaatgtgcactctattcaataagcatcttttggcacgttaataaatcatgtgaaaaaaaaatactactatttcaaagaaagtgttgtaaaaagaaacggaaagagagctggcttcagttgttgagacttgtttgctagtaaaaatggtgtgaagagtgattcatggtgaggtggtttttcgtccctttctgtttgcatgaaaaacaaatggcaagagatgacgtaggattccttcccttaacgattatctgtttttaatttcaaatatacatataggaatttatgaattactaaggttgtaaaatatgctggtcatttatttatggctaaaatatttttttttctcgtaaatataaaaatatttaaaatttatttttatcatattttttatccttataaaattatgtgtacaacctatataaaaaaatatcatatttaatattgattatatgtttaatcaatataaaaaatcattatcatatatttagatttattcgaatatacatctaaacaaaaaataacatattttaattttatgaagaaaaaaaaatattttatcctttatttatttaagattaattaatagttatgtattgtggaaagacttttacacatgcaatagatatactgaatcaattagatgccaatgctgagttggaaatcacttgaggaggggaggagacttgccaatgcttttcagtttcatttaaatgatttagtggaggagatagagtagtgataaaggcatgccccaattttggagtgtatatatgagtggaaataagagagggatagagagaaaaaataaagagagtaaaaataattaatgtgaaatgatatgataaaaaaataaagaaagagataaagagaaaaatgaaatgagagatagatgaaatagagagtagatacatgtttgtttaggttttttttaggaaataacacatttttttctcatcacttattactcactgtcaatttcctctctttcaatcataatgatatgatttgtttaacaaaaatgtgaaaaaacatataaagtaaaatatttttataaattgataaataaaaatttacaaaatttatttcttattaaattgaatagaaaatgaaagaaaagaaaagaaaaagtatatataaaatgatatagctttaaaaagaataaatttttcatatcagtctttttttaataatttagaaatatttaagtatatagcaaaaatataatgtactttacatatgcataaataataatttgaaaatagaactaatagaatagagaaaaaagtaatataataattaactatatgaaaatttagaagggacaatatttttaattaagaatataaacaatatttcttttcatgtaatgagggacggatgtacggggccagtgttggagtcaaagccaaaatagtcacggggaaattaatgcactgcatgactattcgaaaaaattcactagccttacttagatgttagattaatagctagggggtgcagataattttgaaaggcatgaaaaacattaatttgtacattgcaagcttttgatgacaagctttgcaattgttcacactaccttatgccatttataaatagagtgattggcatatgaaggaaatcatgagagtcgaagcgaaaaacaaagcttgagagtgtaggaaaaatacagtttttttggtaaaaatacagtatttgaataggagcgaaaaatatcctttcaaaatgatccttttctttttttttttttttcttgttgttcttggtcagttattcaaaggaaaagggattgaaataaaaacttgcatgtgggatc

SEQ ID NO: 126 - DNA, 709 bp, Artificial Sequence
  oligonucleotide HPfad3A'-2
gattgtggccatggaaggagatagataagcagagaaaacatggtagcccaacacagtgttgatattgctattccttttctctcactgggtgggaacagattgctgtagggattgaagtgagagccttcctttccggggcttcttgaaaacaaataaattggatacacaaacaatggaaatggcacagtgaatctaatgagtcttgtcatgctgtctagattcttgtaaatcttctctgttaatggaacccatgactcatccttctcaatgtgtccatggttttgatggtgagttctgtggctaattctccatccatggtatggcacaagaattgaggaatgcaagatgtgtcccaccaggctattcagcaaagggctatctgaaaagcttccatggccacaatcatgtccaagaacaaagagagcccagaacattgtgccttgaatggggcaatagattagccagagaagccagttgtcgaagtgaattgctgcagccaccaatgcagcaattacaagcacatccctgagaacataactgagggatctccatggattcttgacccagcaatgttttggtattgaagctctgatttctgcaatcttaaacggtggaggagcgctaggatcaaaatcaaaagaagaacccttttgttggtatccattattggcagcataggctaaaggctttgtgtctttaacgcggccgc

SEQ ID NO: 127 - DNA, 1014 bp, Artificial Sequence
  oligonucleotide  HPfad3ABA'-2
gcggccgcgttaaagacacaaagcctttagcctatgctgccaataatggataccaacaaaagggttcttcttttgattttgatcctagcgctcctccaccgtttaagattgcagaaatcagagcttcaataccaaaacattgctgggtcaagaatccatggagatccctcagttatgttctcagggatgtgcttgtaattgctgcattggtggctgcagcaattcacttcgacaactggcttctctggctaatctattgccccattcaaggcacaatgttctgggctctctttgttcttggacatgattgtggccatggaaggagatagataagcagagaaaacatggtagcccaacacagtgttgatattgctattccttttctctcactgggtgggaacagattgctgtagggattgaagtgagagccttcctttccggggcttcttgaaaacaaataaattggatacacaaacaatggaaatggcacagtgaatctaatgagtcttgtcatgctgtctagattcttgtaaatcttctctgttaatggaacccatgactcatccttctcaatgtgtccatggttttgatggtgagttctgtggctaattctccatccatggtatggcacaagaattgaggaatgcaagatgtgtcccaccaggctattcagcaaagggctatctgaaaagcttccatggccacaatcatgtccaagaacaaagagagcccagaacattgtgccttgaatggggcaatagattagccagagaagccagttgtcgaagtgaattgctgcagccaccaatgcagcaattacaagcacatccctgagaacataactgagggatctccatggattcttgacccagcaatgttttggtattgaagctctgatttctgcaatcttaaacggtggaggagcgctaggatcaaaatcaaaagaagaacccttttgttggtatccattattggcagcataggctaaaggctttgtgtctttaacgcggccgc

SEQ ID NO: 128 - DNA, 4526 bp, Artificial Sequence
  plasmid pLF129
ttgtaatacgactcactatagggcgaattgggccctctagatgcatgctcgagcggccgccagtgtgatggatatctgcagaattcagggcggccgcgttaaagacacaaagcctttagcctatgctgccaataatggataccaacaaaagggttcttcttttgattttgatcctagcgctcctccaccgtttaagattgcagaaatcagagcttcaataccaaaacattgctgggtcaagaatccatggagatccctcagttatgttctcagggatgtgcttgtaattgctgcattggtggctgcagcaattcacttcgacaactggcttctctggctaatctattgccccattcaaggcacaatgttctgggctctctttgttcttggacatgattgtggccatggaaggagatagataagcagagaaaacatggtagcccaacacagtgttgatattgctattccttttctctcactgggtgggaacagattgctgtagggattgaagtgagagccttcctttccggggcttcttgaaaacaaataaattggatacacaaacaatggaaatggcacagtgaatctaatgagtcttgtcatgctgtctagattcttgtaaatcttctctgttaatggaacccatgactcatccttctcaatgtgtccatggttttgatggtgagttctgtggctaattctccatccatggtatggcacaagaattgaggaatgcaagatgtgtcccaccaggctattcagcaaagggctatctgaaaagcttccatggccacaatcatgtccaagaacaaagagagcccagaacattgtgccttgaatggggcaatagattagccagagaagccagttgtcgaagtgaattgctgcagccaccaatgcagcaattacaagcacatccctgagaacataactgagggatctccatggattcttgacccagcaatgttttggtattgaagctctgatttctgcaatcttaaacggtggaggagcgctaggatcaaaatcaaaagaagaacccttttgttggtatccattattggcagcataggctaaaggctttgtgtctttaacgcggccgccctgaattccagcacactggcggccgttactagtggatccgagctcggtaccaagcttgatgcatagcttgagtattctaacgcgtcacctaaatagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttagcacgtgtcagtcctgctcctcggccacgaagtgcacgcagttgccggccgggtcgcgcagggcgaactcccgcccccacggctgctcgccgatctcggtcatggccggcccggaggcgtcccggaagttcgtggacacgacctccgaccactcggcgtacagctcgtccaggccgcgcacccacacccaggccagggtgttgtccggcaccacctggtcctggaccgcgctgatgaacagggtcacgtcgtcccggaccacaccggcgaagtcgtcctccacgaagtcccgggagaacccgagccggtcggtccagaactcgaccgctccggcgacgtcgcgcgcggtgagcaccggaacggcactggtcaacttggccatggtggccctcctcacgtgctattattgaagcatttatcagggttattgtctcatgagcggatacatatttgaatgtatttagaaaaataaacaaataggggttccgcgcacatttccccgaaaagtgccacctgatgcggtgtgaaataccgcacagatgcgtaaggagaaaataccgcatcaggaaattgtaagcgttaataattcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcctcgccgtcgggcatgctcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcttgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatcctcatcctgtctcttgatcagagcttgatcccctgcgccatcagatccttggcggcaagaaagccatccagtttactttgcagggcttcccaaccttaccagagggcgccccagctggcaattccggttcgcttgctgtccataaaaccgcccagtctagctatcgccatgtaagcccactgcaagctacctgctttctctttgcgcttgcgttttcccttgtccagatagcccagtagctgacattcatccggggtcagcaccgtttctgcggactggctttctacgtgaaaaggatctaggtgaagatcctttttgataatctcatgcctgacatttatattccccagaacatcaggttaatggcgtttttgatgtcattttcgcggtggctgagatcagccacttcttccccgataacggagaccggcacactggccatatcggtggtcatcatgcgccagctttcatccccgatatgcaccaccgggtaaagttcacgggagactttatctgacagcagacgtgcactggccagggggatcaccatccgtcgccccggcgtgtcaataatatcactctgtacatccacaaacagacgataacggctctctcttttataggtgtaaaccttaaactgccgtacgtataggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaa

SEQ ID NO: 129 - DNA, 8503 bp, Artificial Sequence
  pKR1189
ggccgcatgagccgtaaaggttcaatacaacgagtgcttgttttcttagggacaagcattgtacttatgtatgattctgtgtaaccatgagtcttccacgttgtactaatgtgaagggcaaaaataaaacacagaacaagttcgtttttctcaaataatgtgaaggtagaaaatggaaccatgcctcctctcttgcatgtgatttaaaatattagcagatggtaccgtacgtctagaggatccaagcttggcgcgccgttctatagtgtcacctaaatcgtatgtgtatgatacataaggttatgtattaattgtagccgcgttctaacgacaatatgtccatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcaggttgatcagattcgacatcgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatctgcttcgacgcactccttctttaggtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatggcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggctttttcatggtttaataagaagagaaaagagttcttttgttatggctgaagtaatagagaaatgagctcgagcgtgtcctctccaaatgaaatgaacttccttatatagaggaagggtcttgcgaaggatagtgggattgtgcgtcatcccttacgtcagtggagatgtcacatcaatccacttgctttgaagacgtggttggaacgtcttctttttccacgatgctcctcgtgggtgggggtccatctttgggaccactgtcggcagaggcatcttgaatgatagcctttcctttatcgcaatgatggcatttgtaggagccaccttccttttctactgtcctttcgatgaagtgacagatagctgggcaatggaatccgaggaggtttcccgaaattatcctttgttgaaaagtctcaatagccctttggtcttctgagactgtatctttgacatttttggagtagaccagagtgtcgtgctccaccatgttgacgaagattttcttcttgtcattgagtcgtaaaagactctgtatgaactgttcgccagtcttcacggcgagttctgttagatcctcgatttgaatcttagactccatgcatggccttagattcagtaggaactacctttttagagactccaatctctattacttgccttggtttatgaagcaagccttgaatcgtccatactggaatagtacttctgatcttgagaaatatgtctttctctgtgttcttgatgcaattagtcctgaatcttttgactgcatctttaaccttcttgggaaggtatttgatctcctggagattgttactcgggtagatcgtcttgatgagacctgctgcgtaggcctctctaaccatctgtgggtcagcattctttctgaaattgaagaggctaaccttctcattatcagtggtgaacatagtgtcgtcaccttcaccttcgaacttccttcctagatcgtaaagatagaggaaatcgtccattgtaatctccggggcaaaggagatctcttttggggctggatcactgctgggccttttggttcctagcgtgagccagtgggctttttgctttggtgggcttgttagggccttagcaaagctcttgggcttgagttgagcttctcctttggggatgaagttcaacctgtctgtttgctgacttgttgtgtacgcgtcagctgctgctcttgcctctgtaatagtggcaaatttcttgtgtgcaactccgggaacgccgtttgttgccgcctttgtacaaccccagtcatcgtatataccggcatgtggaccgttatacacaacgtagtagttgatatgagggtgttgaatacccgattctgctctgagaggagcaactgtgctgttaagctcagatttttgtgggattggaattggatcgatctcgatcccgcgaaattaatacgactcactatagggagaccacaacggtttccctctagaaataattttgtttaactttaagaaggagatatacccatggaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacagcttggatcgatccggctgctaacaaagcccgaaaggaagctgagttggctgctgccaccgctgagcaataactagcataaccccttggggcctctaaacgggtcttgaggggttttttgctgaaaggaggaactatatccggatgatcgggcgcgccgtcgactcgacgtacgatcccacatgcaagtttttatttcaatcccttttcctttgaataactgaccaagaacaacaagaaaaaaaaaaaaaaagaaaaggatcattttgaaaggatatttttcgctcctattcaaatactgtatttttaccaaaaaaactgtatttttcctacactctcaagctttgtttttcgcttcgactctcatgatttccttcatatgccaatcactctatttataaatggcataaggtagtgtgaacaattgcaaagcttgtcatcaaaagcttgcaatgtacaaattaatgtttttcatgcctttcaaaattatctgcaccccctagctattaatctaacatctaagtaaggctagtgaattttttcgaatagtcatgcagtgcattaatttccccgtgactattttggctttgactccaacactggccccgtacatccgtccctcattacatgaaaagaaatattgtttatattcttaattaaaaatattgtcccttctaaattttcatatagttaattattatattacttttttctctattctattagttctattttcaaattattatttatgcatatgtaaagtacattatatttttgctatatacttaaatatttctaaattattaaaaaaagactgatatgaaaaatttattctttttaaagctatatcattttatatatactttttcttttcttttctttcattttctattcaatttaataagaaataaattttgtaaatttttatttatcaatttataaaaatattttactttatatgttttttcacatttttgttaaacaaatcatatcattatgattgaaagagaggaaattgacagtgagtaataagtgatgagaaaaaaatgtgttatttcctaaaaaaaacctaaacaaacatgtatctactctctatttcatctatctctcatttcatttttctctttatctctttctttatttttttatcatatcatttcacattaattatttttactctctttattttttctctctatccctctcttatttccactcatatatacactccaaaattggggcatgcctttatcactactctatctcctccactaaatcatttaaatgaaactgaaaagcattggcaagtctcctcccctcctcaagtgatttccaactcagcattggcatctaattgattcagtatatctattgcatgtgtaaaagtctttccacaatacataactattaattaatcttaaataaataaaggataaaatatttttttttcttcataaaattaaaatatgttattttttgtttagatgtatattcgaataaatctaaatatatgataatgattttttatattgattaaacatataatcaatattaaatatgatatttttttatataggttgtacacataattttataaggataaaaaatatgataaaaataaattttaaatatttttatatttacgagaaaaaaaaatattttagccataaataaatgaccagcatattttacaaccttagtaattcataaattcctatatgtatatttgaaattaaaaacagataatcgttaagggaaggaatcctacgtcatctcttgccatttgtttttcatgcaaacagaaagggacgaaaaaccacctcaccatgaatcactcttcacaccatttttactagcaaacaagtctcaacaactgaagccagctctctttccgtttctttttacaacactttctttgaaatagtagtatttttttttcacatgatttattaacgtgccaaaagatgcttattgaatagagtgcacatttgtaatgtactactaattagaacatgaaaaagcattgttctaacacgataatcctgtgaaggcgttaactccaaagatccaatttcactatataaattgtgacgaaagcaaaatgaattcacatagctgagagagaaaggaaaggttaactaagaagcaatacttcagcggccgcgttaaagacacaaagcctttagcctatgctgccaataatggataccaacaaaagggttcttcttttgattttgatcctagcgctcctccaccgtttaagattgcagaaatcagagcttcaataccaaaacattgctgggtcaagaatccatggagatccctcagttatgttctcagggatgtgcttgtaattgctgcattggtggctgcagcaattcacttcgacaactggcttctctggctaatctattgccccattcaaggcacaatgttctgggctctctttgttcttggacatgattgtggccatggaagcttttcagatagccctttgctgaatagcctggtgggacacatcttgcattcctcaattcttgtgccataccatggatggagaattagccacagaactcaccatcaaaaccatggacacattgagaaggatgagtcatgggttccattaacagagaagatttacaagaatctagacagcatgacaagactcattagattcactgtgccatttccattgtttgtgtatccaatttatttgttttcaagaagccccggaaaggaaggctctcacttcaatccctacagcaatctgttcccacccagtgagagaaaaggaatagcaatatcaacactgtgttgggctaccatgttttctctgcttatctatctccttccatggccacaatcatgtccaagaacaaagagagcccagaacattgtgccttgaatggggcaatagattagccagagaagccagttgtcgaagtgaattgctgcagccaccaatgcagcaattacaagcacatccctgagaacataactgagggatctccatggattcttgacccagcaatgttttggtattgaagctctgatttctgcaatcttaaacggtggaggagcgctaggatcaaaatcaaaagaagaacccttttgttggtatccattattggcagcataggctaaaggctttgtgtctttaacgc

SEQ ID NO: 130 - DNA, 4112 bp, Artificial Sequence
  pKR1209
agcttgatgcatagcttgagtattctaacgcgtcacctaaatagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttagcacgtgtcagtcctgctcctcggccacgaagtgcacgcagttgccggccgggtcgcgcagggcgaactcccgcccccacggctgctcgccgatctcggtcatggccggcccggaggcgtcccggaagttcgtggacacgacctccgaccactcggcgtacagctcgtccaggccgcgcacccacacccaggccagggtgttgtccggcaccacctggtcctggaccgcgctgatgaacagggtcacgtcgtcccggaccacaccggcgaagtcgtcctccacgaagtcccgggagaacccgagccggtcggtccagaactcgaccgctccggcgacgtcgcgcgcggtgagcaccggaacggcactggtcaacttggccatggtggccctcctcacgtgctattattgaagcatttatcagggttattgtctcatgagcggatacatatttgaatgtatttagaaaaataaacaaataggggttccgcgcacatttccccgaaaagtgccacctgatgcggtgtgaaataccgcacagatgcgtaaggagaaaataccgcatcaggaaattgtaagcgttaataattcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcctcgccgtcgggcatgctcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcttgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatcctcatcctgtctcttgatcagagcttgatcccctgcgccatcagatccttggcggcaagaaagccatccagtttactttgcagggcttcccaaccttaccagagggcgccccagctggcaattccggttcgcttgctgtccataaaaccgcccagtctagctatcgccatgtaagcccactgcaagctacctgctttctctttgcgcttgcgttttcccttgtccagatagcccagtagctgacattcatccggggtcagcaccgtttctgcggactggctttctacgtgaaaaggatctaggtgaagatcctttttgataatctcatgcctgacatttatattccccagaacatcaggttaatggcgtttttgatgtcattttcgcggtggctgagatcagccacttcttccccgataacggagaccggcacactggccatatcggtggtcatcatgcgccagctttcatccccgatatgcaccaccgggtaaagttcacgggagactttatctgacagcagacgtgcactggccagggggatcaccatccgtcgccccggcgtgtcaataatatcactctgtacatccacaaacagacgataacggctctctcttttataggtgtaaaccttaaactgccgtacgtataggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggccctctagatgcatgctcgagcggccgcgttaaagacacaaagcctttagcctatgctgccaataatggataccaacaaaagggttcttcttttgattttgatcctagcgctcctccaccgtttaagattgcagaaatcagagcttcaataccaaaacattgctgggtcaagaatccatggagatccctcagttatgttctcagggatgtgcttgtaattgctgcattggtggctgcagcaattcacttcgacaactggcttctctggctaatctattgccccattcaaggcacaatgttctgggctctctttgttcttggacatgattgtggccatggaaggagatagataagcagagaaaacatggtagcccaacacagtgttgatattgctattccttttctctcactgggtgggaacagattgctgtagggattgaagtgagagccttcctttccggggcttcttgaaaacaaataaattggatacacaaacaatggaaatggcacagtgaatctaatgagtcttgtcatgctgtctagattcttgtaaatcttctctgttaatggaacccatgactcatccttctcaatgtgtccatggttttgatggtgagttctgtggctaattctccatccatggtatggcacaagaattgaggaatgcaagatgtgtcccaccaggctattcagcaaagggctatctgaaa

SEQ ID NO: 131 - DNA, 1143 bp, Glycine max
atggttcaagcacagcctctacaacatgttggtaatggtgcagggaaagaagatcaagcttattttgatccaagtgctccaccacccttcaagattgcaaatatcagagcagcaattccaaaacattgctgggagaagaacacattgagatctctgagttatgttctgagggatgtgttggtagtgactgcattggtagctgcagcaatcggcttcaatagctggttcttctggccactctattggcctgcacaaggcacaatgttttgggcactttttgttcttggacatgattgtggtcatggaagtttttcaaacagtcctttgttgaacagcattgtgggccacatcttgcactcttcaattcttgtaccataccatggatggagaattagccacaggactcaccatcagaaccatggccatgttgagaaggatgaatcatgggttccgcttacagagaaagtttacaagaatctagacaacatgacaagaatgatgagattcactcttcctttccccatctttgcataccccttttatttgtggagcagaagccctggaaaagaaggctctcatttcaacccttacagcaacttgttctctcctggtgagagaagagatgtgctaacttcaactctgtgttggggcatcatgctttctgtgcttctctatctttccctcacaatgggtccactttttatgctcaagctctatggggttccctatttgatcttcgtcatgtggctggatttcgtcacgtacttgcatcatcatggttacaagcagaaactgccttggtaccgtggccaggaatggagttatctaaggggtggtcttacaacagtagatcgcgactatggttggatcaacaacattcaccatgacattggcacccatgttatccatcaccttttccctcaaattccacattatcatttaatcgaagcgactaaagcagcaaaggcagtgctaggaaagtattatcgtgagcctcagaaatctgggccattgccacttcatctaataaagtacttgctccacagcataagtcaggatcacttcgttagcgactctggcgacattgtgtactaccagactgattcccagctccacaaagattcttggacccagtccaactaa

SEQ ID NO: 132 - protein, 380 aa, Glycine max
MVQAQPLQHVGNGAGKEDQAYFDPSAPPPFKIANIRAAIPKHCWEKNTLRSLSYVLRDVLVVTALVAAAIGFNSWFFWPLYWPAQGTMFWALFVLGHDCGHGSFSNSPLLNSIVGHILHSSILVPYHGWRISHRTHHQNHGHVEKDESWVPLTEKVYKNLDNMTRMMRFTLPFPIFAYPFYLWSRSPGKEGSHFNPYSNLFSPGERRDVLTSTLCWGIMLSVLLYLSLTMGPLFMLKLYGVPYLIFVMWLDFVTYLHHHGYKQKLPWYRGQEWSYLRGGLTTVDRDYGWINNIHHDIGTHVIHHLFPQIPHYHLIEATKAAKAVLGKYYREPQKSGPLPLHLIKYLLHSISQDHFVSDSGDIVYYQTDSQLHKDSWTQSN

SEQ ID NO: 133 - DNA, 40 bp, Artificial Sequence
  oligonucleotide fad3c-5
ctcgagaagcggccgcattgatccaagtgctccaccaccc

SEQ ID NO: 134 - DNA, 28 bp, Artificial Sequence
  oligonucleotide fad3c-3
gatatctatgtccaagaacaaaaagtgc

SEQ ID NO: 135 - DNA, 3764 bp, Artificial Sequence
  plasmid pKR1213
aattccagcacactggcggccgttactagtggatccgagctcggtaccaagcttgatgcatagcttgagtattctaacgcgtcacctaaatagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaagcccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttagcacgtgtcagtcctgctcctcggccacgaagtgcacgcagttgccggccgggtcgcgcagggcgaactcccgcccccacggctgctcgccgatctcggtcatggccggcccggaggcgtcccggaagttcgtggacacgacctccgaccactcggcgtacagctcgtccaggccgcgcacccacacccaggccagggtgttgtccggcaccacctggtcctggaccgcgctgatgaacagggtcacgtcgtcccggaccacaccggcgaagtcgtcctccacgaagtcccgggagaacccgagccggtcggtccagaactcgaccgctccggcgacgtcgcgcgcggtgagcaccggaacggcactggtcaacttggccatggtggccctcctcacgtgctattattgaagcatttatcagggttattgtctcatgagcggatacatatttgaatgtatttagaaaaataaacaaataggggttccgcgcacatttccccgaaaagtgccacctgtatgcggtgtgaaataccgcacagatgcgtaaggagaaaataccgcatcaggaaattgtaagcgttaataattcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcctcgccgtcgggcatgctcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcttgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatcctcatcctgtctcttgatcagagcttgatcccctgcgccatcagatccttggcggcgagaaagccatccagtttactttgcagggcttcccaaccttaccagagggcgccccagctggcaattccggttcgcttgctgtccataaaaccgcccagtctagctatcgccatgtaagcccactgcaagctacctgctttctctttgcgcttgcgttttcccttgtccagatagcccagtagctgacattcatccggggtcagcaccgtttctgcggactggctttctacgtgaaaaggatctaggtgaagatcctttttgataatctcatgcctgacatttatattccccagaacatcaggttaatggcgtttttgatgtcattttcgcggtggctgagatcagccacttcttccccgataacggagaccggcacactggccatatcggtggtcatcatgcgccagctttcatccccgatatgcaccaccgggtaaagttcacgggagactttatctgacagcagacgtgcactggccagggggatcaccatccgtcgccccggcgtgtcaataatatcactctgtacatccacaaacagacgataacggctctctcttttataggtgtaaaccttaaactgccgtacgtataggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggccctctagatgcatgctcgagcggccgccagtgtgatggatatctgcagaattcagggatatctatgtccaagaacaaaaagtgcccaaaacattgtgccttgtgcaggccaatagagtggccagaagaaccagctattgaagccgattgctgcagctaccaatgcagtcactaccaacacatccctcagaacataactcagagatctcaatgtgttcttctcccagcaatgttttggaattgctgctctgatatttgcaatcttgaagggtggtggagcacttggatcaatgcggccgcttctcgagcctg

SEQ ID NO: 136 - DNA, 4353 bp, Artificial Sequence
  plasmid pKR1218
ggccgcgttaaagacacaaagcctttagcctatgctgccaataatggataccaacaaaagggttcttcttttgattttgatcctagcgctcctccaccgtttaagattgcagaaatcagagcttcaataccaaaacattgctgggtcaagaatccatggagatccctcagttatgttctcagggatgtgcttgtaattgctgcattggtggctgcagcaattcacttcgacaactggcttctctggctaatctattgccccattcaaggcacaatgttctgggctctctttgttcttggacatgattgtggccatggaaggagatagataagcagagaaaacatggtagcccaacacagtgttgatattgctattccttttctctcactgggtgggaacagattgctgtagggattgaagtgagagccttcctttccggggcttcttgaaaacaaataaattggatacacaaacaatggaaatggcacagtgaatctaatgagtcttgtcatgctgtctagattcttgtaaatcttctctgttaatggaacccatgactcatccttctcaatgtgtccatggttttgatggtgagttctgtggctaattctccatccatggtatggcacaagaattgaggaatgcaagatgtgtcccaccaggctattcagcaaagggctatctgaaaagcttgatgcatagcttgagtattctaacgcgtcacctaaatagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttagcacgtgtcagtcctgctcctcggccacgaagtgcacgcagttgccggccgggtcgcgcagggcgaactcccgcccccacggctgctcgccgatctcggtcatggccggcccggaggcgtcccggaagttcgtggacacgacctccgaccactcggcgtacagctcgtccaggccgcgcacccacacccaggccagggtgttgtccggcaccacctggtcctggaccgcgctgatgaacagggtcacgtcgtcccggaccacaccggcgaagtcgtcctccacgaagtcccgggagaacccgagccggtcggtccagaactcgaccgctccggcgacgtcgcgcgcggtgagcaccggaacggcactggtcaacttggccatggtggccctcctcacgtgctattattgaagcatttatcagggttattgtctcatgagcggatacatatttgaatgtatttagaaaaataaacaaataggggttccgcgcacatttccccgaaaagtgccacctgatgcggtgtgaaataccgcacagatgcgtaaggagaaaataccgcatcaggaaattgtaagcgttaataattcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcctcgccgtcgggcatgctcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcttgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatcctcatcctgtctcttgatcagagcttgatcccctgcgccatcagatccttggcggcaagaaagccatccagtttactttgcagggcttcccaaccttaccagagggcgccccagctggcaattccggttcgcttgctgtccataaaaccgcccagtctagctatcgccatgtaagcccactgcaagctacctgctttctctttgcgcttgcgttttcccttgtccagatagcccagtagctgacattcatccggggtcagcaccgtttctgcggactggctttctacgtgaaaaggatctaggtgaagatcctttttgataatctcatgcctgacatttatattccccagaacatcaggttaatggcgtttttgatgtcattttcgcggtggctgagatcagccacttcttccccgataacggagaccggcacactggccatatcggtggtcatcatgcgccagctttcatccccgatatgcaccaccgggtaaagttcacgggagactttatctgacagcagacgtgcactggccagggggatcaccatccgtcgccccggcgtgtcaataatatcactctgtacatccacaaacagacgataacggctctctcttttataggtgtaaaccttaaactgccgtacgtataggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggccctctagatgcatgctcgagaagcggccgcattgatccaagtgctccaccacccttcaagattgcaaatatcagagcagcaattccaaaacattgctgggagaagaacacattgagatctctgagttatgttctgagggatgtgttggtagtgactgcattggtagctgcagcaatcggcttcaatagctggttcttctggccactctattggcctgcacaaggcacaatgttttgggcactttttgttcttggacatagat

SEQ ID NO: 137 - DNA, 3742 bp, Artificial Sequence
  plasmid pKR1210
agcttgatgcatagcttgagtattctaacgcgtcacctaaatagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttagcacgtgtcagtcctgctcctcggccacgaagtgcacgcagttgccggccgggtcgcgcagggcgaactcccgcccccacggctgctcgccgatctcggtcatggccggcccggaggcgtcccggaagttcgtggacacgacctccgaccactcggcgtacagctcgtccaggccgcgcacccacacccaggccagggtgttgtccggcaccacctggtcctggaccgcgctgatgaacagggtcacgtcgtcccggaccacaccggcgaagtcgtcctccacgaagtcccgggagaacccgagccggtcggtccagaactcgaccgctccggcgacgtcgcgcgcggtgagcaccggaacggcactggtcaacttggccatggtggccctcctcacgtgctattattgaagcatttatcagggttattgtctcatgagcggatacatatttgaatgtatttagaaaaataaacaaataggggttccgcgcacatttccccgaaaagtgccacctgatgcggtgtgaaataccgcacagatgcgtaaggagaaaataccgcatcaggaaattgtaagcgttaataattcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcctcgccgtcgggcatgctcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcttgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatcctcatcctgtctcttgatcagagcttgatcccctgcgccatcagatccttggcggcaagaaagccatccagtttactttgcagggcttcccaaccttaccagagggcgccccagctggcaattccggttcgcttgctgtccataaaaccgcccagtctagctatcgccatgtaagcccactgcaagctacctgctttctctttgcgcttgcgttttcccttgtccagatagcccagtagctgacattcatccggggtcagcaccgtttctgcggactggctttctacgtgaaaaggatctaggtgaagatcctttttgataatctcatgcctgacatttatattccccagaacatcaggttaatggcgtttttgatgtcattttcgcggtggctgagatcagccacttcttccccgataacggagaccggcacactggccatatcggtggtcatcatgcgccagctttcatccccgatatgcaccaccgggtaaagttcacgggagactttatctgacagcagacgtgcactggccagggggatcaccatccgtcgccccggcgtgtcaataatatcactctgtacatccacaaacagacgataacggctctctcttttataggtgtaaaccttaaactgccgtacgtataggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggccctctagatgcatgctcgagcggccgcgttaaagacacaaagcctttagcctatgctgccaataatggataccaacaaaagggttcttcttttgattttgatcctagcgctcctccaccgtttaagattgcagaaatcagagcttcaataccaaaacattgctgggtcaagaatccatggagatccctcagttatgttctcagggatgtgcttgtaattgctgcattggtggctgcagcaattcacttcgacaactggcttctctggctaatctattgccccattcaaggcacaatgttctgggctctctttgttcttggacatgattgtggccatgga

SEQ ID NO: 138 - DNA, 3983 bp, Artificial Sequence
  plasmid pKR1219
ggccgcgttaaagacacaaagcctttagcctatgctgccaataatggataccaacaaaagggttcttcttttgattttgatcctagcgctcctccaccgtttaagattgcagaaatcagagcttcaataccaaaacattgctgggtcaagaatccatggagatccctcagttatgttctcagggatgtgcttgtaattgctgcattggtggctgcagcaattcacttcgacaactggcttctctggctaatctattgccccattcaaggcacaatgttctgggctctctttgttcttggacatgattgtggccatggaagcttgatgcatagcttgagtattctaacgcgtcacctaaatagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttagcacgtgtcagtcctgctcctcggccacgaagtgcacgcagttgccggccgggtcgcgcagggcgaactcccgcccccacggctgctcgccgatctcggtcatggccggcccggaggcgtcccggaagttcgtggacacgacctccgaccactcggcgtacagctcgtccaggccgcgcacccacacccaggccagggtgttgtccggcaccacctggtcctggaccgcgctgatgaacagggtcacgtcgtcccggaccacaccggcgaagtcgtcctccacgaagtcccgggagaacccgagccggtcggtccagaactcgaccgctccggcgacgtcgcgcgcggtgagcaccggaacggcactggtcaacttggccatggtggccctcctcacgtgctattattgaagcatttatcagggttattgtctcatgagcggatacatatttgaatgtatttagaaaaataaacaaataggggttccgcgcacatttccccgaaaagtgccacctgatgcggtgtgaaataccgcacagatgcgtaaggagaaaataccgcatcaggaaattgtaagcgttaataattcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcctcgccgtcgggcatgctcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcttgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatcctcatcctgtctcttgatcagagcttgatcccctgcgccatcagatccttggcggcaagaaagccatccagtttactttgcagggcttcccaaccttaccagagggcgccccagctggcaattccggttcgcttgctgtccataaaaccgcccagtctagctatcgccatgtaagcccactgcaagctacctgctttctctttgcgcttgcgttttcccttgtccagatagcccagtagctgacattcatccggggtcagcaccgtttctgcggactggctttctacgtgaaaaggatctaggtgaagatcctttttgataatctcatgcctgacatttatattccccagaacatcaggttaatggcgtttttgatgtcattttcgcggtggctgagatcagccacttcttccccgataacggagaccggcacactggccatatcggtggtcatcatgcgccagctttcatccccgatatgcaccaccgggtaaagttcacgggagactttatctgacagcagacgtgcactggccagggggatcaccatccgtcgccccggcgtgtcaataatatcactctgtacatccacaaacagacgataacggctctctcttttataggtgtaaaccttaaactgccgtacgtataggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggccctctagatgcatgctcgagaagcggccgcattgatccaagtgctccaccacccttcaagattgcaaatatcagagcagcaattccaaaacattgctgggagaagaacacattgagatctctgagttatgttctgagggatgtgttggtagtgactgcattggtagctgcagcaatcggcttcaatagctggttcttctggccactctattggcctgcacaaggcacaatgttttgggcactttttgttcttggacatagat

SEQ ID NO: 139 - DNA, 4894 bp, Artificial Sequence
  plasmid pKR1225
cgcgtcacctaaatagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttagcacgtgtcagtcctgctcctcggccacgaagtgcacgcagttgccggccgggtcgcgcagggcgaactcccgcccccacggctgctcgccgatctcggtcatggccggcccggaggcgtcccggaagttcgtggacacgacctccgaccactcggcgtacagctcgtccaggccgcgcacccacacccaggccagggtgttgtccggcaccacctggtcctggaccgcgctgatgaacagggtcacgtcgtcccggaccacaccggcgaagtcgtcctccacgaagtcccgggagaacccgagccggtcggtccagaactcgaccgctccggcgacgtcgcgcgcggtgagcaccggaacggcactggtcaacttggccatggtggccctcctcacgtgctattattgaagcatttatcagggttattgtctcatgagcggatacatatttgaatgtatttagaaaaataaacaaataggggttccgcgcacatttccccgaaaagtgccacctgatgcggtgtgaaataccgcacagatgcgtaaggagaaaataccgcatcaggaaattgtaagcgttaataattcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcctcgccgtcgggcatgctcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcttgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatcctcatcctgtctcttgatcagagcttgatcccctgcgccatcagatccttggcggcaagaaagccatccagtttactttgcagggcttcccaaccttaccagagggcgccccagctggcaattccggttcgcttgctgtccataaaaccgcccagtctagctatcgccatgtaagcccactgcaagctacctgctttctctttgcgcttgcgttttcccttgtccagatagcccagtagctgacattcatccggggtcagcaccgtttctgcggactggctttctacgtgaaaaggatctaggtgaagatcctttttgataatctcatgcctgacatttatattccccagaacatcaggttaatggcgtttttgatgtcattttcgcggtggctgagatcagccacttcttccccgataacggagaccggcacactggccatatcggtggtcatcatgcgccagctttcatccccgatatgcaccaccgggtaaagttcacgggagactttatctgacagcagacgtgcactggccagggggatcaccatccgtcgccccggcgtgtcaataatatcactctgtacatccacaaacagacgataacggctctctcttttataggtgtaaaccttaaactgccgtacgtataggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggccctctagatgcatgctcgagaagcggccgcattgatccaagtgctccaccacccttcaagattgcaaatatcagagcagcaattccaaaacattgctgggagaagaacacattgagatctctgagttatgttctgagggatgtgttggtagtgactgcattggtagctgcagcaatcggcttcaatagctggttcttctggccactctattggcctgcacaaggcacaatgttttgggcactttttgttcttggacatagatggccgcgttaaagacacaaagcctttagcctatgctgccaataatggataccaacaaaagggttcttcttttgattttgatcctagcgctcctccaccgtttaagattgcagaaatcagagcttcaataccaaaacattgctgggtcaagaatccatggagatccctcagttatgttctcagggatgtgcttgtaattgctgcattggtggctgcagcaattcacttcgacaactggcttctctggctaatctattgccccattcaaggcacaatgttctgggctctctttgttcttggacatgattgtggccatggaagcttttcagatagccctttgctgaatagcctggtgggacacatcttgcattcctcaattcttgtgccataccatggatggagaattagccacagaactcaccatcaaaaccatggacacattgagaaggatgagtcatgggttccattaacagagaagatttacaagaatctagacagcatgacaagactcattagattcactgtgccatttccattgtttgtgtatccaatttatttgttttcaagaagccccggaaaggaaggctctcacttcaatccctacagcaatctgttcccacccagtgagagaaaaggaatagcaatatcaacactgtgttgggctaccatgttttctctgcttatctatctccttccatggccacaatcatgtccaagaacaaagagagcccagaacattgtgccttgaatggggcaatagattagccagagaagccagttgtcgaagtgaattgctgcagccaccaatgcagcaattacaagcacatccctgagaacataactgagggatctccatggattcttgacccagcaatgttttggtattgaagctctgatttctgcaatcttaaacggtggaggagcgctaggatcaaaatcaaaagaagaacccttttgttggtatccattattggcagcataggctaaaggctttgtgtctttaacgcggccatctatgtccaagaacaaaaagtgcccaaaacattgtgccttgtgcaggccaatagagtggccagaagaaccagctattgaagccgattgctgcagctaccaatgcagtcactaccaacacatccctcagaacataactcagagatctcaatgtgttcttctcccagcaatgttttggaattgctgctctgatatttgcaatcttgaagggtggtggagcacttggatcaatgcggccgcttctcga

SEQ ID NO: 140 - DNA, 8979 bp, Artificial Sequence
  plasmid pKR1229
ggccgcatgagccgtaaaggttcaatacaacgagtgcttgttttcttagggacaagcattgtacttatgtatgattctgtgtaaccatgagtcttccacgttgtactaatgtgaagggcaaaaataaaacacagaacaagttcgtttttctcaaataatgtgaaggtagaaaatggaaccatgcctcctctcttgcatgtgatttaaaatattagcagatggtaccgtacgtctagaggatccaagcttggcgcgccgttctatagtgtcacctaaatcgtatgtgtatgatacataaggttatgtattaattgtagccgcgttctaacgacaatatgtccatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcaggttgatcagattcgacatcgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatctgcttcgacgcactccttctttaggtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatggcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggctttttcatggtttaataagaagagaaaagagttcttttgttatggctgaagtaatagagaaatgagctcgagcgtgtcctctccaaatgaaatgaacttccttatatagaggaagggtcttgcgaaggatagtgggattgtgcgtcatcccttacgtcagtggagatgtcacatcaatccacttgctttgaagacgtggttggaacgtcttctttttccacgatgctcctcgtgggtgggggtccatctttgggaccactgtcggcagaggcatcttgaatgatagcctttcctttatcgcaatgatggcatttgtaggagccaccttccttttctactgtcctttcgatgaagtgacagatagctgggcaatggaatccgaggaggtttcccgaaattatcctttgttgaaaagtctcaatagccctttggtcttctgagactgtatctttgacatttttggagtagaccagagtgtcgtgctccaccatgttgacgaagattttcttcttgtcattgagtcgtaaaagactctgtatgaactgttcgccagtcttcacggcgagttctgttagatcctcgatttgaatcttagactccatgcatggccttagattcagtaggaactacctttttagagactccaatctctattacttgccttggtttatgaagcaagccttgaatcgtccatactggaatagtacttctgatcttgagaaatatgtctttctctgtgttcttgatgcaattagtcctgaatcttttgactgcatctttaaccttcttgggaaggtatttgatctcctggagattgttactcgggtagatcgtcttgatgagacctgctgcgtaggcctctctaaccatctgtgggtcagcattctttctgaaattgaagaggctaaccttctcattatcagtggtgaacatagtgtcgtcaccttcaccttcgaacttccttcctagatcgtaaagatagaggaaatcgtccattgtaatctccggggcaaaggagatctcttttggggctggatcactgctgggccttttggttcctagcgtgagccagtgggctttttgctttggtgggcttgttagggccttagcaaagctcttgggcttgagttgagcttctcctttggggatgaagttcaacctgtctgtttgctgacttgttgtgtacgcgtcagctgctgctcttgcctctgtaatagtggcaaatttcttgtgtgcaactccgggaacgccgtttgttgccgcctttgtacaaccccagtcatcgtatataccggcatgtggaccgttatacacaacgtagtagttgatatgagggtgttgaatacccgattctgctctgagaggagcaactgtgctgttaagctcagatttttgtgggattggaattggatcgatctcgatcccgcgaaattaatacgactcactatagggagaccacaacggtttccctctagaaataattttgtttaactttaagaaggagatatacccatggaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacagcttggatcgatccggctgctaacaaagcccgaaaggaagctgagttggctgctgccaccgctgagcaataactagcataaccccttggggcctctaaacgggtcttgaggggttttttgctgaaaggaggaactatatccggatgatcgggcgcgccgtcgactcgacgtacgatcccacatgcaagtttttatttcaatcccttttcctttgaataactgaccaagaacaacaagaaaaaaaaaaaaaaagaaaaggatcattttgaaaggatatttttcgctcctattcaaatactgtatttttaccaaaaaaactgtatttttcctacactctcaagctttgtttttcgcttcgactctcatgatttccttcatatgccaatcactctatttataaatggcataaggtagtgtgaacaattgcaaagcttgtcatcaaaagcttgcaatgtacaaattaatgtttttcatgcctttcaaaattatctgcaccccctagctattaatctaacatctaagtaaggctagtgaattttttcgaatagtcatgcagtgcattaatttccccgtgactattttggctttgactccaacactggccccgtacatccgtccctcattacatgaaaagaaatattgtttatattcttaattaaaaatattgtcccttctaaattttcatatagttaattattatattacttttttctctattctattagttctattttcaaattattatttatgcatatgtaaagtacattatatttttgctatatacttaaatatttctaaattattaaaaaaagactgatatgaaaaatttattctttttaaagctatatcattttatatatactttttcttttcttttctttcattttctattcaatttaataagaaataaattttgtaaatttttatttatcaatttataaaaatattttactttatatgttttttcacatttttgttaaacaaatcatatcattatgattgaaagagaggaaattgacagtgagtaataagtgatgagaaaaaaatgtgttatttcctaaaaaaaacctaaacaaacatgtatctactctctatttcatctatctctcatttcatttttctctttatctctttctttatttttttatcatatcatttcacattaattatttttactctctttattttttctctctatccctctcttatttccactcatatatacactccaaaattggggcatgcctttatcactactctatctcctccactaaatcatttaaatgaaactgaaaagcattggcaagtctcctcccctcctcaagtgatttccaactcagcattggcatctaattgattcagtatatctattgcatgtgtaaaagtctttccacaatacataactattaattaatcttaaataaataaaggataaaatatttttttttcttcataaaattaaaatatgttattttttgtttagatgtatattcgaataaatctaaatatatgataatgattttttatattgattaaacatataatcaatattaaatatgatatttttttatataggttgtacacataattttataaggataaaaaatatgataaaaataaattttaaatatttttatatttacgagaaaaaaaaatattttagccataaataaatgaccagcatattttacaaccttagtaattcataaattcctatatgtatatttgaaattaaaaacagataatcgttaagggaaggaatcctacgtcatctcttgccatttgtttttcatgcaaacagaaagggacgaaaaaccacctcaccatgaatcactcttcacaccatttttactagcaaacaagtctcaacaactgaagccagctctctttccgtttctttttacaacactttctttgaaatagtagtatttttttttcacatgatttattaacgtgccaaaagatgcttattgaatagagtgcacatttgtaatgtactactaattagaacatgaaaaagcattgttctaacacgataatcctgtgaaggcgttaactccaaagatccaatttcactatataaattgtgacgaaagcaaaatgaattcacatagctgagagagaaaggaaaggttaactaagaagcaatacttcagcggccgcattgatccaagtgctccaccacccttcaagattgcaaatatcagagcagcaattccaaaacattgctgggagaagaacacattgagatctctgagttatgttctgagggatgtgttggtagtgactgcattggtagctgcagcaatcggcttcaatagctggttcttctggccactctattggcctgcacaaggcacaatgttttgggcactttttgttcttggacatagatggccgcgttaaagacacaaagcctttagcctatgctgccaataatggataccaacaaaagggttcttcttttgattttgatcctagcgctcctccaccgtttaagattgcagaaatcagagcttcaataccaaaacattgctgggtcaagaatccatggagatccctcagttatgttctcagggatgtgcttgtaattgctgcattggtggctgcagcaattcacttcgacaactggcttctctggctaatctattgccccattcaaggcacaatgttctgggctctctttgttcttggacatgattgtggccatggaagcttttcagatagccctttgctgaatagcctggtgggacacatcttgcattcctcaattcttgtgccataccatggatggagaattagccacagaactcaccatcaaaaccatggacacattgagaaggatgagtcatgggttccattaacagagaagatttacaagaatctagacagcatgacaagactcattagattcactgtgccatttccattgtttgtgtatccaatttatttgttttcaagaagccccggaaaggaaggctctcacttcaatccctacagcaatctgttcccacccagtgagagaaaaggaatagcaatatcaacactgtgttgggctaccatgttttctctgcttatctatctccttccatggccacaatcatgtccaagaacaaagagagcccagaacattgtgccttgaatggggcaatagattagccagagaagccagttgtcgaagtgaattgctgcagccaccaatgcagcaattacaagcacatccctgagaacataactgagggatctccatggattcttgacccagcaatgttttggtattgaagctctgatttctgcaatcttaaacggtggaggagcgctaggatcaaaatcaaaagaagaacccttttgttggtatccattattggcagcataggctaaaggctttgtgtctttaacgcggccatctatgtccaagaacaaaaagtgcccaaaacattgtgccttgtgcaggccaatagagtggccagaagaaccagctattgaagccgattgctgcagctaccaatgcagtcactaccaacacatccctcagaacataactcagagatctcaatgtgttcttctcccagcaatgttttggaattgctgctctgatatttgcaatcttgaagggtggtggagcacttggatcaatgc

SEQ ID NO: 141 - DNA, 10221 bp, Artificial Sequence
  plasmid pKR1249
gtacgtctagaggatccgtcgacggcgcgcccgatcatccggatatagttcctcctttcagcaaaaaacccctcaagacccgtttagaggccccaaggggttatgctagttattgctcagcggtggcagcagccaactcagcttcctttcgggctttgttagcagccggatcgatccaagctgtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggcttttccatgggtatatctccttcttaaagttaaacaaaattatttctagagggaaaccgttgtggtctccctatagtgagtcgtattaatttcgcgggatcgagatctgatcaacctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatggacatattgtcgttagaacgcggctacaattaatacataaccttatgtatcatacacatacgatttaggtgacactatagaacggcgcgccaagctgggtctagaactagaaacgtgatgccacttgttattgaagtcgattacagcatctattctgttttactatttataactttgccatttctgacttttgaaaactatctctggatttcggtatcgctttgtgaagatcgagcaaaagagacgttttgtggacgcaatggtccaaatccgttctacatgaacaaattggtcacaatttccactaaaagtaaataaatggcaagttaaaaaaggaatatgcattttactgattgcctaggtgagctccaagagaagttgaatctacacgtctaccaaccgctaaaaaaagaaaaacattgaatatgtaacctgattccattagcttttgacttcttcaacagattctctacttagatttctaacagaaatattattactagcacatcattttcagtctcactacagcaaaaaatccaacggcacaatacagacaacaggagatatcagactacagagatagatagatgctactgcatgtagtaagttaaataaaaggaaaataaaatgtcttgctaccaaaactactacagactatgatgctcaccacaggccaaatcctgcaactaggacagcattatcttatatatattgtacaaaacaagcatcaaggaacatttggtctaggcaatcagtacctcgttctaccatcaccctcagttatcacatccttgaaggatccattactgggaatcatcggcaacacatgctcctgatggggcacaatgacatcaagaaggtaggggccaggggtgtccaacattctctgaattgccgctctaagctcttccttcttcgtcactcgcgctgccggtatcccacaagcatcagcaaacttgagcatgtttgggaatatctcgctctcgctagacggatctccaagataggtgtgagctctattggacttgtagaacctatcctccaactgaaccaccatacccaaatgctgattgttcaacaacaatatcttaactgggagattctccactcttatagtggccaactcctgaacattcatgatgaaactaccatccccatcaatgtcaaccacaacagccccagggttagcaacagcagcaccaatagccgcaggcaatccaaaacccatggctccaagaccccctgaggtcaaccactgcctcggtctcttgtacttgtaaaactgcgcagcccacatttgatgctgcccaaccccagtactaacaatagcatctccattagtcaactcatcaagaacctcgatagcatgctgcggagaaatcgcgtcctggaatgtcttgtaacccaatggaaacttgtgtttctgcacattaatctcttctctccaacctccaagatcaaacttaccctccactcctttctcctccaaaatcatattaattcccttcaaggccaacttcaaatccgcgcaaaccgacacgtgcgcctgcttgttcttcccaatctcggcagaatcaatatcaatgtgaacaatcttagccctactagcaaaagcctcaagcttcccagtaacacggtcatcaaaccttaccccaaaggcaagcaacaaatcactattgtcaacagcatagttagcataaacagtaccatgcatacccagcatctgaagggaatattcatcaccaataggaaaagttccaagacccattaaagtgctagcaacgggaataccagtgagttcaacaaagcgcctcaattcagcactggaattcaaactgccaccgccgacgtagagaacgggcttttgggcctccatgatgagtctgacaatgtgttccaattgggcctcggcggggggcctgggcagcctggcgaggtaaccggggaggttaacgggctcgtcccaattaggcacggcgagttgctgctgaacgtctttgggaatgtcgatgaggaccggaccggggcggccggaggtggcgacgaagaaagcctcggcgacgacgcgggggatgtcgtcgacgtcgaggatgaggtagttgtgcttcgtgatggatctgctcacctccacgatcggggtttcttggaaggcgtcggtgccgatcatccggcgggcgacctggccggtgatggcgacgactgggacgctgtccattaaagcgtcggcgaggccgctcacgaggttggtggcgccggggccggaggtggcaatgcagacgccggggaggccggaggaacgcgcgtagccttcggcggcgaagacgccgccctgctcgtggcgcgggagcacgttgcggatggcggcggagcgcgtgagcgcctggtggatctccatcgacgcaccgccggggtacgcgaacaccgtcgtcacgccctgcctctccagcgcctccacaaggatgtccgcgcccttgcgaggttcgccggaggcgaaccgtgacacgaagggctccgtggtcggcgcttccttggtgaagggcgccgccgtggggggtttggagatggaacatttgattttgagagcgtggttgggtttggtgagggtttgatgagagagagggagggtggatctagtaatgcgtttggggaaggtggggtgtgaagaggaagaagagaatcgggtggttctggaagcggtggccgccattgtgttgtgtggcatggttatacttcaaaaactgcacaacaagcctagagttagtacctaaacagtaaatttacaacagagagcaaagacacatgcaaaaatttcagccataaaaaaagttataatagaatttaaagcaaaagtttcattttttaaacatatatacaaacaaactggatttgaaggaagggattaattcccctgctcaaagtttgaattcctattgtgacctatactcgaataaaattgaagcctaaggaatgtatgagaaacaagaaaacaaaacaaaactacagacaaacaagtacaattacaaaattcgctaaaattctgtaatcaccaaaccccatctcagtcagcacaaggcccaaggtttattttgaaataaaaaaaaagtgattttatttctcataagctaaaagaaagaaaggcaattatgaaatgatttcgactagatctgaaagtcaaacgcgtattccgcagatattaaagaaagagtagagtttcacatggatcctagatggacccagttgaggaaaaagcaaggcaaagcaaaccagaagtgcaagatccgaaattgaaccacggaatctaggatttggtagagggagaagaaaagtaccttgagaggtagaagagaagagaagagcagagagatatatgaacgagtgtgtcttggtctcaactctgaagcgatacgagtttagaggggagcattgagttccaatttatagggaaaccgggtggcaggggtgagttaatgacggaaaagcccctaagtaacgagattggattgtgggttagattcaaccgtttgcatccgcggcttagattggggaagtcagagtgaatctcaaccgttgactgagttgaaaattgaatgtagcaaccaattgagccaaccccagcctttgccctttgattttgatttgtttgttgcatactttttatttgtcttctggttctgactctctttctctcgtttcaatgccaggttgcctactcccacaccactcacaagaagattctactgttagtattaaatattttttaatgtattaaatgatgaatgcttttgtaaacagaacaagactatgtctaataagtgtcttgcaacattttttaagaaattaaaaaaaatatatttattatcaaaatcaaatgtatgaaaaatcatgaataatataattttatacatttttttaaaaaatcttttaatttcttaattaatatcttaaaaataatgattaatatttaacccaaaataattagtatgattggtaaggaagatatccatgttatgtttggatgtgagtttgatctagagcaaagcttactagagtcgacctgcaggtcgactcgacgtacgatcccacatgcaagtttttatttcaatcccttttcctttgaataactgaccaagaacaacaagaaaaaaaaaaaaaaagaaaaggatcattttgaaaggatatttttcgctcctattcaaatactgtatttttaccaaaaaaactgtatttttcctacactctcaagctttgtttttcgcttcgactctcatgatttccttcatatgccaatcactctatttataaatggcataaggtagtgtgaacaattgcaaagcttgtcatcaaaagcttgcaatgtacaaattaatgtttttcatgcctttcaaaattatctgcaccccctagctattaatctaacatctaagtaaggctagtgaattttttcgaatagtcatgcagtgcattaatttccccgtgactattttggctttgactccaacactggccccgtacatccgtccctcattacatgaaaagaaatattgtttatattcttaattaaaaatattgtcccttctaaattttcatatagttaattattatattacttttttctctattctattagttctattttcaaattattatttatgcatatgtaaagtacattatatttttgctatatacttaaatatttctaaattattaaaaaaagactgatatgaaaaatttattctttttaaagctatatcattttatatatactttttcttttcttttctttcattttctattcaatttaataagaaataaattttgtaaatttttatttatcaatttataaaaatattttactttatatgttttttcacatttttgttaaacaaatcatatcattatgattgaaagagaggaaattgacagtgagtaataagtgatgagaaaaaaatgtgttatttcctaaaaaaaacctaaacaaacatgtatctactctctatttcatctatctctcatttcatttttctctttatctctttctttatttttttatcatatcatttcacattaattatttttactctctttattttttctctctatccctctcttatttccactcatatatacactccaaaattggggcatgcctttatcactactctatctcctccactaaatcatttaaatgaaactgaaaagcattggcaagtctcctcccctcctcaagtgatttccaactcagcattggcatctaattgattcagtatatctattgcatgtgtaaaagtctttccacaatacataactattaattaatcttaaataaataaaggataaaatatttttttttcttcataaaattaaaatatgttattttttgtttagatgtatattcgaataaatctaaatatatgataatgattttttatattgattaaacatataatcaatattaaatatgatatttttttatataggttgtacacataattttataaggataaaaaatatgataaaaataaattttaaatatttttatatttacgagaaaaaaaaatattttagccataaataaatgaccagcatattttacaaccttagtaattcataaattcctatatgtatatttgaaattaaaaacagataatcgttaagggaaggaatcctacgtcatctcttgccatttgtttttcatgcaaacagaaagggacgaaaaaccacctcaccatgaatcactcttcacaccatttttactagcaaacaagtctcaacaactgaagccagctctctttccgtttctttttacaacactttctttgaaatagtagtatttttttttcacatgatttattaacgtgccaaaagatgcttattgaatagagtgcacatttgtaatgtactactaattagaacatgaaaaagcattgttctaacacgataatcctgtgaaggcgttaactccaaagatccaatttcactatataaattgtgacgaaagcaaaatgaattcacatagctgagagagaaaggaaaggttaactaagaagcaatacttcagcggccgcattgatccaagtgctccaccacccttcaagattgcaaatatcagagcagcaattccaaaacattgctgggagaagaacacattgagatctctgagttatgttctgagggatgtgttggtagtgactgcattggtagctgcagcaatcggcttcaatagctggttcttctggccactctattggcctgcacaaggcacaatgttttgggcactttttgttcttggacatagatggccgcgttaaagacacaaagcctttagcctatgctgccaataatggataccaacaaaagggttcttcttttgattttgatcctagcgctcctccaccgtttaagattgcagaaatcagagcttcaataccaaaacattgctgggtcaagaatccatggagatccctcagttatgttctcagggatgtgcttgtaattgctgcattggtggctgcagcaattcacttcgacaactggcttctctggctaatctattgccccattcaaggcacaatgttctgggctctctttgttcttggacatgattgtggccatggaagcttttcagatagccctttgctgaatagcctggtgggacacatcttgcattcctcaattcttgtgccataccatggatggagaattagccacagaactcaccatcaaaaccatggacacattgagaaggatgagtcatgggttccattaacagagaagatttacaagaatctagacagcatgacaagactcattagattcactgtgccatttccattgtttgtgtatccaatttatttgttttcaagaagccccggaaaggaaggctctcacttcaatccctacagcaatctgttcccacccagtgagagaaaaggaatagcaatatcaacactgtgttgggctaccatgttttctctgcttatctatctccttccatggccacaatcatgtccaagaacaaagagagcccagaacattgtgccttgaatggggcaatagattagccagagaagccagttgtcgaagtgaattgctgcagccaccaatgcagcaattacaagcacatccctgagaacataactgagggatctccatggattcttgacccagcaatgttttggtattgaagctctgatttctgcaatcttaaacggtggaggagcgctaggatcaaaatcaaaagaagaacccttttgttggtatccattattggcagcataggctaaaggctttgtgtctttaacgcggccatctatgtccaagaacaaaaagtgcccaaaacattgtgccttgtgcaggccaatagagtggccagaagaaccagctattgaagccgattgctgcagctaccaatgcagtcactaccaacacatccctcagaacataactcagagatctcaatgtgttcttctcccagcaatgttttggaattgctgctctgatatttgcaatcttgaagggtggtggagcacttggatcaatgcggccgcatgagccgtaaaggttcaatacaacgagtgcttgttttcttagggacaagcattgtacttatgtatgattctgtgtaaccatgagtcttccacgttgtactaatgtgaagggcaaaaataaaacacagaacaagttcgtttttctcaaataatgtgaaggtagaaaatggaaccatgcctcctctcttgcatgtgatttaaaatattagcagatggtacc

SEQ ID NO: 142 - protein, 1263 aa, Euglena gracilis
ATGAAGTCAAAGCGCCAAGCGCTTCCCCTTACAATTGATGGAACAACATATGATGTGTCTGCCTGGGTCAATTTCCACCCTGGTGGTGCGGAAATTATAGAGAATTACCAAGGAAGGGATGCCACTGATGCCTTCATGGTTATGCACTCTCAAGAAGCCTTCGACAAGCTCAAGCGCATGCCCAAAATCAATCCCAGTTCTGAGTTGCCACCCCAGGCTGCAGTGAATGAAGCTCAAGAGGATTTCCGGAAGCTCCGAGAAGAGTTGATCGCAACTGGCATGTTTGATGCCTCCCCCCTCTGGTACTCATACAAAATCAGCACCACACTGGGCCTTGGAGTGCTGGGTTATTTCCTGATGGTTCAGTATCAGATGTATTTCATTGGGGCAGTGTTGCTTGGGATGCACTATCAACAGATGGGCTGGCTTTCTCATGACATTTGCCACCACCAGACTTTCAAGAACCGGAACTGGAACAACCTCGTGGGACTGGTATTTGGCAATGGTCTGCAAGGTTTTTCCGTGACATGGTGGAAGGACAGACACAATGCACATCATTCGGCAACCAATGTTCAAGGGCACGACCCTGATATTGACAACCTCCCCCTCTTAGCCTGGTCTGAGGATGACGTCACACGGGCGTCACCGATTTCCCGCAAGCTCATTCAGTTCCAGCAGTACTATTTCTTGGTCATCTGTATCTTGTTGCGGTTCATTTGGTGTTTCCAGAGCGTGTTGACCGTGCGCAGTTTGAAGGACAGAGATAACCAATTCTATCGCTCTCAGTATAAGAAGGAGGCCATTGGCCTCGCCCTGCACTGGACCTTGAAGACCCTGTTCCACTTATTCTTTATGCCCAGCATCCTCACATCGCTGTTGGTGTTTTTCGTTTCGGAGCTGGTTGGCGGCTTCGGCATTGCGATCGTGGTGTTCATGAACCACTACCCACTGGAGAAGATCGGGGACTCAGTCTGGGATGGCCATGGATTCTCGGTTGGCCAGATCCATGAGACCATGAACATTCGGCGAGGGATTATCACAGATTGGTTTTTCGGAGGCTTGAATTACCAGATTGAGCACCATTTGTGGCCGACCCTCCCTCGCCACAACCTGACAGCGGTTAGCTACCAGGTGGAACAGCTGTGCCAGAAGCACAACCTGCCGTATCGGAACCCGCTGCCCCATGAAGGGTTGGTCATCCTGCTGCGCTATCTGGCGGTGTTCGCCCGGATGGCGGAGAAGCAACCCGCGGGGAAGGCTCTA

SEQ ID NO: 143 - DNA, 27 bp, Artificial Sequence
  oligonucleotide pDonor222Eg5-1
gccaactttgtacaaaaaagttggatt

SEQ ID NO: 144 - protein, 21 aa, Artificial Sequence
  degenerate oligonucleotide D8DEG3-1
RTTRTGNCKATCTTTCCACCA

SEQ ID NO: 145 - protein, 21 aa, Artificial Sequence
  degenerate oligonucleotide  D8DEG3-2
RTTRTGNCKGTCTTTCCACCA

SEQ ID NO: 146 - protein, 21 aa, Artificial Sequence
  degenerate oligonucleotide  D8DEG3-3
RTTRTGNCKATCCTTCCACCA

SEQ ID NO: 147 - protein, 21 aa, Artificial Sequence
  degenerate oligonucleotide  D8DEG3-4
RTTRTGNCKGTCCTTCCACCA

SEQ ID NO: 148 - DNA, 4116 bp, Artificial Sequence
  plasmid pHD23-1
cctgaattccagcacactggcggccgttactagtggatccgagctcggtaccaagcttgatgcatagcttgagtattctaacgcgtcacctaaatagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttagcacgtgtcagtcctgctcctcggccacgaagtgcacgcagttgccggccgggtcgcgcagggcgaactcccgcccccacggctgctcgccgatctcggtcatggccggcccggaggcgtcccggaagttcgtggacacgacctccgaccactcggcgtacagctcgtccaggccgcgcacccacacccaggccagggtgttgtccggcaccacctggtcctggaccgcgctgatgaacagggtcacgtcgtcccggaccacaccggcgaagtcgtcctccacgaagtcccgggagaacccgagccggtcggtccagaactcgaccgctccggcgacgtcgcgcgcggtgagcaccggaacggcactggtcaacttggccatggtggccctcctcacgtgctattattgaagcatttatcagggttattgtctcatgagcggatacatatttgaatgtatttagaaaaataaacaaataggggttccgcgcacatttccccgaaaagtgccacctgatgcggtgtgaaataccgcacagatgcgtaaggagaaaataccgcatcaggaaattgtaagcgttaataattcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcctcgccgtcgggcatgctcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcttgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatcctcatcctgtctcttgatcagagcttgatcccctgcgccatcagatccttggcggcaagaaagccatccagtttactttgcagggcttcccaaccttaccagagggcgccccagctggcaattccggttcgcttgctgtccataaaaccgcccagtctagctatcgccatgtaagcccactgcaagctacctgctttctctttgcgcttgcgttttcccttgtccagatagcccagtagctgacattcatccggggtcagcaccgtttctgcggactggctttctacgtgaaaaggatctaggtgaagatcctttttgataatctcatgcctgacatttatattccccagaacatcaggttaatggcgtttttgatgtcattttcgcggtggctgagatcagccacttcttccccgataacggagaccggcacactggccatatcggtggtcatcatgcgccagctttcatccccgatatgcaccaccgggtaaagttcacgggagactttatctgacagcagacgtgcactggccagggggatcaccatccgtcgccccggcgtgtcaataatatcactctgtacatccacaaacagacgataacggctctctcttttataggtgtaaaccttaaactgccgtacgtataggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggccctctagatgcatgctcgagcggccgccagtgtgatggatatctgcagaattcagggccaactttgtacaaaaaagttggattttttttcggcccacgatctcacatggtgaaaaggccagcacttccgctgaccgttgatggtgtcacctatgatgtgtctgcctggttgaaccatcatccagggggtgctgacatcattgagaactaccgcggtcgtgatgccactgatgtctttatggttatgcactctgaaaatgctgtgagtaaactaagaaggatgcctatcatggaaccatcatctccactgacgcctacgccaccgaaacccaactcagacgaaccgcaggaggatttccgcaagctccgagatgagctcatcgcagcaggaatgttcgacgcatcaccgatgtggtacgcatataagacgctcactacgctgggcctcggggtcctcgcggtgctattgatgacccagtggcactggtacctcgtcggggcaatcgtgttgggcattcacttccaacaaatgggttggttgtcgcacgatatctgccaccatcagctgttcaaggaccgatcgatcaacaacgccatcggcttgcttttcgggaacgtcttgcaagggttctctgtgacctggtggaaggacagtcacaac

SEQ ID NO: 149 - protein, 419 aa, Euglena gracilis
MKSKRQALSPLQLMEQTYDVVNFHPGGAEIIENYQGRDATDAFMVMHFQEAFDKLKRMPKINPSFELPPQAAVNEAQEDFRKLREELIATGMFDASPLWYSYKISTTLGLGVLGYFLMVQYQMYFIGAVLLGMHYQQMGWLSHDICHHQTFKNRNWNNLVGLVFGNGLQGFSVTCWKDRHNAHHSATNVQGHDPDIDNLPPLAWSEDDVTRASPISRKLIQFQQYYFLVICILLRFIWCFQCVLTVRSLKDRDNQFYRSQYKKEAIGLALHWTLKALFHLFFMPSILTSLLVFFVSELVGGFGIAIVVFMNHYPLEKIGDPVWDGHGFSVGQIHETMNIRRGIITDWFFGGLNYQIEHHLWPTLPRHNLTAVSYQVEQLCQKHNLPYRNPLPHEGLVILLRYLAVFARMAEKQPAGKAL

SEQ ID NO: 150 - DNA, 4307 bp, Artificial Sequence
  plasmid pLF118-3
  misc_feature (4255)..(4294): n is a, c, g, or t
gtacaaagttggcattataagaaagcattgcttatcaatttgttgcaacgaacaggtcactatcagtcaaaataaaatcattatttgccatccagctgatatcccctatagtgagtcgtattacatggtcatagctgtttcctggcagctctggcccgtgtctcaaaatctctgatgttacattgcacaagataaaaatatatcatcatgttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcatagatcttttctccatcactgatagggagtggtaaaataactccatcaatgatagagtgtcaacaacatgaccaaaatcccttaacgtgagttacgcgtattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggttacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagggaacgacgcgtaccgctagccaggaagagtttgtagaaacgcaaaaaggccatccgtcaggatggccttctgcttagtttgatgcctggcagtttatggcgggcgtcctgcccgccaccctccgggccgttgcttcacaacgttcaaatccgctcccggcggatttgtcctactcaggagagcgttcaccgacaaacaacagataaaacgaaaggcccagtcttccgactgagcctttcgttttatttgatgcctggcagttccctactctcgcgttaacgctagcatggatgttttcccagtcacgacgttgtaaaacgacggccagtcttaagctcgggccccaaataatgattttattttgactgatagtgacctgttcgttgcaacaaattgatgagcaatgcttttttataatgccaactttgtacaaaaaagttggctattttttttcggcccacgatctcacatggtgaaaaggccagcacttccgctgaccgttgatggtgtcacctatgatgtgtctgcctggttgaaccatcatccagggggtgctgacatcattgagaactaccgcggtcgtgatgccactgatgtctttatggttatgcactctgaaaatgctgtgagtaaactaagaaggatgcctatcatggaaccatcatctccactgacgcctacgccaccgaaacccaactcagacgaaccgcaggaggatttccgcaagctccgagatgagctcatcgcagcaggaatgttcgacgcatcaccgatgtggtacgcatataagacgctcagtacgctgggcctcggggtcctcgcggtgctattgatgacccagtggcactggtacctcgtcggggcaatcgtgttgggcattcacttccaacaaatgggttggttgtcgcacgatatctgccaccatcagctgttcaaggaccgatcgatcaacaacgccatcggcttgcttttcgggaacgtcttgcaagggttctctgtgacctggtggaaggacaggcacaatgcacaccactccgccaccaacgtgcaaggccacgaccccgacattgacaacctgccgctgctggcatggtccaaggaggacgtggagagggccggcccgttctcacggcggatgatcaagtaccagcaatactacttcttcttcatctgtgccctcctgaggttcatctggtgcttccagagcatccacacagccacgggcctgaaggatcgcagcaaccagtactaccgcaggcagtacgagaaagagagcgtgggcctggccctccactggggcctgaaggcgttgttctactacttttatatgccaagcttcttgaccggactcatggtgtttttcgtgtccgagttgcttgggggcttcggcatcgccatcgtggtgttcatgaaccactaccccctggagaagatccaggactcggtgtgggacggccacggcttttgcgccggccagattcacgaaacgatgaacgtccagcggggactcgtcacggactggttcttcggtgggctgaattaccaaatcgagcaccacctgtggccgacgctgccccggcacaacctgacggcggccagcatcaaagtggagcagttgtgcaagaagcacaacttgccgtatcgcagccccccaatgctggagggggtgggcatcctgatcagctacctgggcacctttgcccgcatggtggcaaaggccgacaaggcgtaagtgacatggcaccgctcaggactctgatagttgggctgacgctttggttgtcatcccttgccccttcatatcacctctggccctactcggattctctctagctctaacctgttcaatgtggactgctacacatatgagttcctcggatctctggggaacagcctttggaagactcggcattcctttatgcttggaaggcttgagacctcttctgcaggactcaaggcaaccctcctcagtgtcgggaaagagtatttgccttcggcctgacctgctatacctcacccaacatgcgtcgtggaattaatgatcattgttaagagtttggtgcgatttctgattgtgcgcaaattgtgcggaggcgcggcacacacgttctcctccggccatcacagtccaaggtcaaatttccaactctaatcaccatgatgggccacagctttgcacactatttctggcagagctgcaagaaactcgcnnnnnnnnnnnnnnnnnnnnnnnnnnnnnnnnnnnnnnnnacccaactttctt

SEQ ID NO: 151 - protein, 1260 aa, Euglena anabaena
ATGGTGAAAAGGCCAGCACTTCCGCTGACCGTTGATGGTGTCACCTATGATGTGTCTGCCTGGTTGAACCATCATCCAGGGGGTGCTGACATCATTGAGAACTACCGCGGTCGTGATGCCACTGATGTCTTTATGGTTATGCACTCTGAAAATGCTGTGAGTAAACTAAGAAGGATGCCTATCATGGAACCATCATCTCCACTGACGCCTACGCCACCGAAACCCAACTCAGACGAACCGCAGGAGGATTTCCGCAAGCTCCGAGATGAGCTCATCGCAGCAGGAATGTTCGACGCATCACCGATGTGGTACGCATATAAGACGCTCAGTACGCTGGGCCTCGGGGTCCTCGCGGTGCTATTGATGACCCAGTGGCACTGGTACCTCGTCGGGGCAATCGTGTTGGGCATTCACTTCCAACAAATGGGTTGGTTGTCGCACGATATCTGCCACCATCAGCTGTTCAAGGACCGATCGATCAACAACGCCATCGGCTTGCTTTTCGGGAACGTCTTGCAAGGGTTCTCTGTGACCTGGTGGAAGGACAGGCACAATGCACACCACTCCGCCACCAACGTGCAAGGCCACGACCCCGACATTGACAACCTGCCGCTGCTGGCATGGTCCAAGGAGGACGTGGAGAGGGCCGGCCCGTTCTCACGGCGGATGATCAAGTACCAGCAATACTACTTCTTCTTCATCTGTGCCCTCCTGAGGTTCATCTGGTGCTTCCAGAGCATCCACACAGCCACGGGCCTGAAGGATCGCAGCAACCAGTACTACCGCAGGCAGTACGAGAAAGAGAGCGTGGGCCTGGCCCTCCACTGGGGCCTGAAGGCGTTGTTCTACTACTTTTATATGCCAAGCTTCTTGACCGGACTCATGGTGTTTTTCGTGTCCGAGTTGCTTGGGGGCTTCGGCATCGCCATCGTGGTGTTCATGAACCACTACCCCCTGGAGAAGATCCAGGACTCGGTGTGGGACGGCCACGGCTTTTGCGCCGGCCAGATTCACGAAACGATGAACGTCCAGCGGGGACTCGTCACGGACTGGTTCTTCGGTGGGCTGAATTACCAAATCGAGCACCACCTGTGGCCGACGCTGCCCCGGCACAACCTGACGGCGGCCAGCATCAAAGTGGAGCAGTTGTGCAAGAAGCACAACTTGCCGTATCGCAGCCCCCCAATGCTGGAGGGGGTGGGCATCCTGATCAGCTACCTGGGCACCTTTGCCCGCATGGTGGCAAAGGCCGACAAGGCG

SEQ ID NO: 152 - protein, 420 aa, Euglena anabaena
MVKRPALPLTVDGVTYDVSAWLNHHPGGADIIENYRGRDATDVFMVMHSENAVSKLRRMPIMEPSSPLTPTPPKPNSDEPQEDFRKLRDELIAAGMFDASPMWYAYKTLSTLGLGVLAVLLMTQWHWYLVGAIVLGIHFQQMGWLSHDICHHQLFKDRSINNAIGLLFGNVLQGFSVTWWKDRHNAHHSATNVQGHDPDIDNLPLLAWSKEDVERAGPFSRRMIKYQQYYFFFICALLRFIWCFQSIHTATGLKDRSNQYYRRQYEKESVGLALHWGLKALFYYFYMPSFLTGLMVFFVSELLGGFGIAIVVFMNHYPLEKIQDSVWDGHGFCAGQIHETMNVQRGLVTDWFFGGLNYQIEHHLWPTLPRHNLTAASIKVEQLCKKHNLPYRSPPMLEGVGILISYLGTFARMVAKADKA

SEQ ID NO: 153 - DNA, 34 bp, Artificial Sequence
  oligonucleotide EaD8-5
gcggccgcaccatggtgaaaaggccagcacttcc

SEQ ID NO: 154 - DNA, 30 bp, Artificial Sequence
  oligonucleotide EaD8-3
gcggccgcttacgccttgtcggcctttgcc

SEQ ID NO: 155 - DNA, 4794 bp, Artificial Sequence
  plasmid pLF120-3
ttgtaatacgactcactatagggcgaattgggccctctagatgcatgctcgagcggccgccagtgtgatggatatctgcagaattcaggcctgaattccagcacactggcggccgttactagtggatccgagctcggtaccaagcttgatgcatagcttgagtattctaacgcgtcacctaaatagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttagcacgtgtcagtcctgctcctcggccacgaagtgcacgcagttgccggccgggtcgcgcagggcgaactcccgcccccacggctgctcgccgatctcggtcatggccggcccggaggcgtcccggaagttcgtggacacgacctccgaccactcggcgtacagctcgtccaggccgcgcacccacacccaggccagggtgttgtccggcaccacctggtcctggaccgcgctgatgaacagggtcacgtcgtcccggaccacaccggcgaagtcgtcctccacgaagtcccgggagaacccgagccggtcggtccagaactcgaccgctccggcgacgtcgcgcgcggtgagcaccggaacggcactggtcaacttggccatggtggccctcctcacgtgctattattgaagcatttatcagggttattgtctcatgagcggatacatatttgaatgtatttagaaaaataaacaaataggggttccgcgcacatttccccgaaaagtgccacctgatgcggtgtgaaataccgcacagatgcgtaaggagaaaataccgcatcaggaaattgtaagcgttaataattcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcctcgccgtcgggcatgctcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcttgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatcctcatcctgtctcttgatcagagcttgatcccctgcgccatcagatccttggcggcaagaaagccatccagtttactttgcagggcttcccaaccttaccagagggcgccccagctggcaattccggttcgcttgctgtccataaaaccgcccagtctagctatcgccatgtaagcccactgcaagctacctgctttctctttgcgcttgcgttttcccttgtccagatagcccagtagctgacattcatccggggtcagcaccgtttctgcggactggctttctacgtgaaaaggatctaggtgaagatcctttttgataatctcatgcctgacatttatattccccagaacatcaggttaatggcgtttttgatgtcattttcgcggtggctgagatcagccacttcttccccgataacggagaccggcacactggccatatcggtggtcatcatgcgccagctttcatccccgatatgcaccaccgggtaaagttcacgggagactttatctgacagcagacgtgcactggccagggggatcaccatccgtcgccccggcgtgtcaataatatcactctgtacatccacaaacagacgataacggctctctcttttataggtgtaaaccttaaactgccgtacgtataggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaagcggccgcaccatggtgaaaaggccagcacttccgctgaccgttgatggtgtcacctatgatgtgtctgcctggttgaaccatcatccagggggtgctgacatcattgagaactaccgcggtcgtgatgccactgatgtctttatggttatgcactctgaaaatgctgtgagtaaactaagaaggatgcctatcatggaaccatcatctccactgacgcctacgccaccgaaacccaactcagacgaaccgcaggaggatttccgcaagctccgagatgagctcatcgcagcaggaatgttcgacgcatcaccgatgtggtacgcatataagacgctcagtacgctgggcctcggggtcctcgcggtgctattgatgacccagtggcactggtacctcgtcggggcaatcgtgttgggcattcacttccaacaaatgggttggttgtcgcacgatatctgccaccatcagctgttcaaggaccgatcgatcaacaacgccatcggcttgcttttcgggaacgtcttgcaagggttctctgtgacctggtggaaggacaggcacaatgcacaccactccgccaccaacgtgcaaggccacgaccccgacattgacaacctgccgctgctggcatggtccaaggaggacgtggagagggccggcccgttctcacggcggatgatcaagtaccagcaatactacttcttcttcatctgtgccctcctgaggttcatctggtgcttccagagcatccacacagccacgggcctgaaggatcgcagcaaccagtactaccgcaggcagtacgagaaagagagcgtgggcctggccctccactggggcctgaaggcgttgttctactacttttatatgccaagcttcttgaccggactcatggtgtttttcgtgtccgagttgcttgggggcttcggcatcgccatcgtggtgttcatgaaccactaccccctggagaagatccaggactcggtgtgggacggccacggcttttgcgccggccagattcacgaaacgatgaacgtccagcggggactcgtcacggactggttcttcggtgggctgaattaccaaatcgagcaccacctgtggccgacgctgccccggcacaacctgacggcggccagcatcaaagtggagcagttgtgcaagaagcacaacttgccgtatcgcagccccccaatgctggagggggtgggcatcctgatcagctacctgggcacctttgcccgcatggtggcaaaggccgacaaggcgtaagcggccgc

SEQ ID NO: 156 - DNA, 33 bp, Artificial Sequence
  oligonucleotide oEAd9el1-1
agcggccgcaccatggaagcagccaaagaattg

SEQ ID NO: 157 - DNA, 26 bp, Artificial Sequence
  oligonucleotide oEAd9el1-2
tgcggccgctactccttcttccctcg

SEQ ID NO: 158 - DNA, 4310 bp, Artificial Sequence
  plasmid pKR1137
aattccagcacactggcggccgttactagtggatccgagctcggtaccaagcttgatgcatagcttgagtattctaacgcgtcacctaaatagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaagcccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttagcacgtgtcagtcctgctcctcggccacgaagtgcacgcagttgccggccgggtcgcgcagggcgaactcccgcccccacggctgctcgccgatctcggtcatggccggcccggaggcgtcccggaagttcgtggacacgacctccgaccactcggcgtacagctcgtccaggccgcgcacccacacccaggccagggtgttgtccggcaccacctggtcctggaccgcgctgatgaacagggtcacgtcgtcccggaccacaccggcgaagtcgtcctccacgaagtcccgggagaacccgagccggtcggtccagaactcgaccgctccggcgacgtcgcgcgcggtgagcaccggaacggcactggtcaacttggccatggtggccctcctcacgtgctattattgaagcatttatcagggttattgtctcatgagcggatacatatttgaatgtatttagaaaaataaacaaataggggttccgcgcacatttccccgaaaagtgccacctgtatgcggtgtgaaataccgcacagatgcgtaaggagaaaataccgcatcaggaaattgtaagcgttaataattcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcctcgccgtcgggcatgctcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcttgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatcctcatcctgtctcttgatcagagcttgatcccctgcgccatcagatccttggcggcgagaaagccatccagtttactttgcagggcttcccaaccttaccagagggcgccccagctggcaattccggttcgcttgctgtccataaaaccgcccagtctagctatcgccatgtaagcccactgcaagctacctgctttctctttgcgcttgcgttttcccttgtccagatagcccagtagctgacattcatccggggtcagcaccgtttctgcggactggctttctacgtgaaaaggatctaggtgaagatcctttttgataatctcatgcctgacatttatattccccagaacatcaggttaatggcgtttttgatgtcattttcgcggtggctgagatcagccacttcttccccgataacggagaccggcacactggccatatcggtggtcatcatgcgccagctttcatccccgatatgcaccaccgggtaaagttcacgggagactttatctgacagcagacgtgcactggccagggggatcaccatccgtcgccccggcgtgtcaataatatcactctgtacatccacaaacagacgataacggctctctcttttataggtgtaaaccttaaactgccgtacgtataggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggccctctagatgcatgctcgagcggccgccagtgtgatggatatctgcagaattcaggagcggccgcaccatggaagcagccaaagaattggtttccatcgtccaagaggagctccccaaggtggactatgcccagctttggcaggatgccagcagctgtgaggtcctttacctctcggtggcattcgtggcgatcaagttcatgctgcgcccactggacctgaagcgccaggccaccttgaagaagctgttcacagcatacaacttcctcatgtcgatctattcctttggctccttcctggccatggcctatgccctatcagtaactggcatcctctccggcgactgtgagacggcgttcaacaacgatgtgttcaggatcacaactcagctgttctacctcagcaagttcgtagagtacatcgactccttctaccttccccttatggacaagccactgtcgttccttcagttcttccatcatttgggggcccccattgacatgtggctattctacaaataccgcaacgaaggagtctggatctttgtcctgttgaatgggttcattcactggatcatgtacggttactattggacgcggctcatcaagctgaacttccccatgcccaagaacctgatcacctccatgcagatcatccagttcaatgtcgggttctacatcgtctggaagtaccgcaatgtgccatgctaccgccaggatgggatgcgcatgtttgcctggatcttcaactactggtatgtcgggacggtcttgctgctgttcctcaacttttacgtgcagacgtacatccggaagccgaggaagaaccgagggaagaaggagtagcggccgcacctg

SEQ ID NO: 159 - DNA, 7872 bp, Artificial Sequence
  plasmid pKR1140
ggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttggcgcgccgttctatagtgtcacctaaatcgtatgtgtatgatacataaggttatgtattaattgtagccgcgttctaacgacaatatgtccatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcaggttgatcgattcgacatcgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatctgcttcgacgcactccttctttaggtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatggcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggctttttcatggtttaataagaagagaaaagagttcttttgttatggctgaagtaatagagaaatgagctcgagcgtgtcctctccaaatgaaatgaacttccttatatagaggaagggtcttgcgaaggatagtgggattgtgcgtcatcccttacgtcagtggagatgtcacatcaatccacttgctttgaagacgtggttggaacgtcttctttttccacgatgctcctcgtgggtgggggtccatctttgggaccactgtcggcagaggcatcttgaatgatagcctttcctttatcgcaatgatggcatttgtaggagccaccttccttttctactgtcctttcgatgaagtgacagatagctgggcaatggaatccgaggaggtttcccgaaattatcctttgttgaaaagtctcaatagccctttggtcttctgagactgtatctttgacatttttggagtagaccagagtgtcgtgctccaccatgttgacgaagattttcttcttgtcattgagtcgtaaaagactctgtatgaactgttcgccagtcttcacggcgagttctgttagatcctcgatttgaatcttagactccatgcatggccttagattcagtaggaactacctttttagagactccaatctctattacttgccttggtttatgaagcaagccttgaatcgtccatactggaatagtacttctgatcttgagaaatatgtctttctctgtgttcttgatgcaattagtcctgaatcttttgactgcatctttaaccttcttgggaaggtatttgatctcctggagattgttactcgggtagatcgtcttgatgagacctgctgcgtaggcctctctaaccatctgtgggtcagcattctttctgaaattgaagaggctaaccttctcattatcagtggtgaacatagtgtcgtcaccttcaccttcgaacttccttcctagatcgtaaagatagaggaaatcgtccattgtaatctccggggcaaaggagatctcttttggggctggatcactgctgggccttttggttcctagcgtgagccagtgggctttttgctttggtgggcttgttagggccttagcaaagctcttgggcttgagttgagcttctcctttggggatgaagttcaacctgtctgtttgctgacttgttgtgtacgcgtcagctgctgctcttgcctctgtaatagtggcaaatttcttgtgtgcaactccgggaacgccgtttgttgccgcctttgtacaaccccagtcatcgtatataccggcatgtggaccgttatacacaacgtagtagttgatatgagggtgttgaatacccgattctgctctgagaggagcaactgtgctgttaagctcagatttttgtgggattggaattggatcgatctcgatcccgcgaaattaatacgactcactatagggagaccacaacggtttccctctagaaataattttgtttaactttaagaaggagatatacccatggaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacagcttggatcgatccggctgctaacaaagcccgaaaggaagctgagttggctgctgccaccgctgagcaataactagcataaccccttggggcctctaaacgggtcttgaggggttttttgctgaaaggaggaactatatccggatgatcgggcgcgccgtcgacggatccgtacgagatccggccggccagatcctgcaggagatccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcaccatggaagcagccaaagaattggtttccatcgtccaagaggagctccccaaggtggactatgcccagctttggcaggatgccagcagctgtgaggtcctttacctctcggtggcattcgtggcgatcaagttcatgctgcgcccactggacctgaagcgccaggccaccttgaagaagctgttcacagcatacaacttcctcatgtcgatctattcctttggctccttcctggccatggcctatgccctatcagtaactggcatcctctccggcgactgtgagacggcgttcaacaacgatgtgttcaggatcacaactcagctgttctacctcagcaagttcgtagagtacatcgactccttctaccttccccttatggacaagccactgtcgttccttcagttcttccatcatttgggggcccccattgacatgtggctattctacaaataccgcaacgaaggagtctggatctttgtcctgttgaatgggttcattcactggatcatgtacggttactattggacgcggctcatcaagctgaacttccccatgcccaagaacctgatcacctccatgcagatcatccagttcaatgtcgggttctacatcgtctggaagtaccgcaatgtgccatgctaccgccaggatgggatgcgcatgtttgcctggatcttcaactactggtatgtcgggacggtcttgctgctgttcctcaacttttacgtgcagacgtacatccggaagccgaggaagaaccgagggaagaaggagtagc

SEQ ID NO: 160 - DNA, 5146 bp, Artificial Sequence
  plasmid pKR1173
cgcgcccgatcatccggatatagttcctcctttcagcaaaaaacccctcaagacccgtttagaggccccaaggggttatgctagttattgctcagcggtggcagcagccaactcagcttcctttcgggctttgttagcagccggatcgatccaagctgtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggcttttccatgggtatatctccttcttaaagttaaacaaaattatttctagagggaaaccgttgtggtctccctatagtgagtcgtattaatttcgcgggatcgagatctgatcaacctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatggacatattgtcgttagaacgcggctacaattaatacataaccttatgtatcatacacatacgatttaggtgacactatagaacggcgcgccgtcgacggatccgtacgagatccggccggccagatcctgcaggagatccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcaccatggaagcagccaaagaattggtttccatcgtccaagaggagctccccaaggtggactatgcccagctttggcaggatgccagcagctgtgaggtcctttacctctcggtggcattcgtggcgatcaagttcatgctgcgcccactggacctgaagcgccaggccaccttgaagaagctgttcacagcatacaacttcctcatgtcgatctattcctttggctccttcctggccatggcctatgccctatcagtaactggcatcctctccggcgactgtgagacggcgttcaacaacgatgtgttcaggatcacaactcagctgttctacctcagcaagttcgtagagtacatcgactccttctaccttccccttatggacaagccactgtcgttccttcagttcttccatcatttgggggcccccattgacatgtggctattctacaaataccgcaacgaaggagtctggatctttgtcctgttgaatgggttcattcactggatcatgtacggttactattggacgcggctcatcaagctgaacttccccatgcccaagaacctgatcacctccatgcagatcatccagttcaatgtcgggttctacatcgtctggaagtaccgcaatgtgccatgctaccgccaggatgggatgcgcatgtttgcctggatcttcaactactggtatgtcgggacggtcttgctgctgttcctcaacttttacgtgcagacgtacatccggaagccgaggaagaaccgagggaagaaggagtagcggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttgg

SEQ ID NO: 161 - DNA, 5250 bp, Artificial Sequence
  plasmid pKR393
gatcccccgggctgcaggaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttgcatgcctgcaggctagcctaagtacgtactcaaaatgccaacaaataaaaaaaaagttgctttaataatgccaaaacaaattaataaaacacttacaacaccggattttttttaattaaaatgtgccatttaggataaatagttaatatttttaataattatttaaaaagccgtatctactaaaatgatttttatttggttgaaaatattaatatgtttaaatcaacacaatctatcaaaattaaactaaaaaaaaaataagtgtacgtggttaacattagtacagtaatataagaggaaaatgagaaattaagaaattgaaagcgagtctaatttttaaattatgaacctgcatatataaaaggaaagaaagaatccaggaagaaaagaaatgaaaccatgcatggtcccctcgtcatcacgagtttctgccatttgcaatagaaacactgaaacacctttctctttgtcacttaattgagatgccgaagccacctcacaccatgaacttcatgaggtgtagcacccaaggcttccatagccatgcatactgaagaatgtctcaagctcagcaccctacttctgtgacgtgtccctcattcaccttcctctcttccctataaataaccacgcctcaggttctccgcttcacaactcaaacattctctccattggtccttaaacactcatcagtcatcaccgcggccgccaattcaggtgcccatgatgttggccgcaggctatcttctagtgctctcggccgctcgccagagcttccagcaggacattgacaaccccaacggggcctactcgacctcgtggactggcctgcccattgtgatgtctgtggtctatctcagcggtgtgtttgggctcacaaagtacttcgagaaccggaagcccatgacggggctgaaggactacatgttcacttacaatctctaccaggtgatcatcaacgtgtggtgcgtggtggcctttctcctggaggtgcggcgtgcgggcatgtcactcatcggcaataaggtggaccttgggcccaactccttcaggctcggcttcgtcacgtgggtgcactacaacaacaagtacgtggagctcctcgacaccctatggatggtgctgcgcaagaagacgcagcaggtctccttcctccacgtctatcatcacgtgcttctgatgtgggcctggttcgttgtcgtcaagctcggcaatggtggtgacgcatattttggcggtctcatgaactcgatcatccacgtgatgatgtattcctactacaccatggcgctcctgggctggtcatgcccctggaagcgctacctcacgcaggcacagctcgtgcagttttgcatctgcctcgcccactccacatgggcggcagtaacgggtgcctacccgtggcgaatttgcttggtggaggtgtgggtgatggtgtccatgctggtgctcttcacacgcttctaccgccaggcctatgccaaggaggcgaaggccaaggaggcgaaaaagctcgcacaggaggcatcacaggccaaggcggtcaaggcggagtaagtcactggaggtggaccgcacatgcaccacgggcccggcgagcagcatggttcggcgagtcaggcccggtcatgcgtcatggttggagtttgcagggcggcaggtgatcgcctccgccatgcacggccacaggcacagccggtcctctggacgtcccaactttcaaccgtggtgcaaagcacgctggcgaccgcgagcagcagtcagcgcagcgtgttatcacagtgtcgctggctgcacgtgctctctccatcgcggccgcatttcgcaccaaatcaatgaaagtaataatgaaaagtctgaataagaatacttaggcttagatgcctttgttacttgtgtaaaataacttgagtcatgtacctttggcggaaacagaataaataaaaggtgaaattccaatgctctatgtataagttagtaatacttaatgtgttctacggttgtttcaatatcatcaaactctaattgaaactttagaaccacaaatctcaatcttttcttaatgaaatgaaaaatcttaattgtaccatgtttatgttaaacaccttacaattggttggagaggaggaccaaccgatgggacaacattgggagaaagagattcaatggagatttggataggagaacaacattctttttcacttcaatacaagatgagtgcaacactaaggatatgtatgagactttcagaagctacgacaacatagatgagtgaggtggtgattcctagcaagaaagacattagaggaagccaaaatcgaacaaggaagacatcaagggcaagagacaggaccatccatctcaggaaaaggagctttgggatagtccgagaagttgtacaagaaattttttggagggtgagtgatgcattgctggtgactttaactcaatcaaaattgagaaagaaagaaaagggagggggctcacatgtgaatagaagggaaacgggagaattttacagttttgatctaatgggcatcccagctagtggtaacatattcaccatgtttaaccttcacgtacgtctagag

SEQ ID NO: 162 - DNA, 4140 bp, Artificial Sequence
  plasmid pKR407
ggccgcatttcgcaccaaatcaatgaaagtaataatgaaaagtctgaataagaatacttaggcttagatgcctttgttacttgtgtaaaataacttgagtcatgtacctttggcggaaacagaataaataaaaggtgaaattccaatgctctatgtataagttagtaatacttaatgtgttctacggttgtttcaatatcatcaaactctaattgaaactttagaaccacaaatctcaatcttttcttaatgaaatgaaaaatcttaattgtaccatgtttatgttaaacaccttacaattggttggagaggaggaccaaccgatgggacaacattgggagaaagagattcaatggagatttggataggagaacaacattctttttcacttcaatacaagatgagtgcaacactaaggatatgtatgagactttcagaagctacgacaacatagatgagtgaggtggtgattcctagcaagaaagacattagaggaagccaaaatcgaacaaggaagacatcaagggcaagagacaggaccatccatctcaggaaaaggagctttgggatagtccgagaagttgtacaagaaattttttggagggtgagtgatgcattgctggtgactttaactcaatcaaaattgagaaagaaagaaaagggagggggctcacatgtgaatagaagggaaacgggagaattttacagttttgatctaatgggcatcccagctagtggtaacatattcaccatgtttaaccttcacgtacgtctagaggatcccccgggctgcaggaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttgcatgcctgcaggctagcctaagtacgtactcaaaatgccaacaaataaaaaaaaagttgctttaataatgccaaaacaaattaataaaacacttacaacaccggattttttttaattaaaatgtgccatttaggataaatagttaatatttttaataattatttaaaaagccgtatctactaaaatgatttttatttggttgaaaatattaatatgtttaaatcaacacaatctatcaaaattaaactaaaaaaaaaataagtgtacgtggttaacattagtacagtaatataagaggaaaatgagaaattaagaaattgaaagcgagtctaatttttaaattatgaacctgcatatataaaaggaaagaaagaatccaggaagaaaagaaatgaaaccatgcatggtcccctcgtcatcacgagtttctgccatttgcaatagaaacactgaaacacctttctctttgtcacttaattgagatgccgaagccacctcacaccatgaacttcatgaggtgtagcacccaaggcttccatagccatgcatactgaagaatgtctcaagctcagcaccctacttctgtgacgtgtccctcattcaccttcctctcttccctataaataaccacgcctcaggttctccgcttcacaactcaaacattctctccattggtccttaaacactcatcagtcatcaccgc

SEQ ID NO: 163 - DNA, 5414 bp, Artificial Sequence
  plasmid pKR1176
ggccgcatttcgcaccaaatcaatgaaagtaataatgaaaagtctgaataagaatacttaggcttagatgcctttgttacttgtgtaaaataacttgagtcatgtacctttggcggaaacagaataaataaaaggtgaaattccaatgctctatgtataagttagtaatacttaatgtgttctacggttgtttcaatatcatcaaactctaattgaaactttagaaccacaaatctcaatcttttcttaatgaaatgaaaaatcttaattgtaccatgtttatgttaaacaccttacaattggttggagaggaggaccaaccgatgggacaacattgggagaaagagattcaatggagatttggataggagaacaacattctttttcacttcaatacaagatgagtgcaacactaaggatatgtatgagactttcagaagctacgacaacatagatgagtgaggtggtgattcctagcaagaaagacattagaggaagccaaaatcgaacaaggaagacatcaagggcaagagacaggaccatccatctcaggaaaaggagctttgggatagtccgagaagttgtacaagaaattttttggagggtgagtgatgcattgctggtgactttaactcaatcaaaattgagaaagaaagaaaagggagggggctcacatgtgaatagaagggaaacgggagaattttacagttttgatctaatgggcatcccagctagtggtaacatattcaccatgtttaaccttcacgtacgtctagaggatcccccgggctgcaggaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttgcatgcctgcaggctagcctaagtacgtactcaaaatgccaacaaataaaaaaaaagttgctttaataatgccaaaacaaattaataaaacacttacaacaccggattttttttaattaaaatgtgccatttaggataaatagttaatatttttaataattatttaaaaagccgtatctactaaaatgatttttatttggttgaaaatattaatatgtttaaatcaacacaatctatcaaaattaaactaaaaaaaaaataagtgtacgtggttaacattagtacagtaatataagaggaaaatgagaaattaagaaattgaaagcgagtctaatttttaaattatgaacctgcatatataaaaggaaagaaagaatccaggaagaaaagaaatgaaaccatgcatggtcccctcgtcatcacgagtttctgccatttgcaatagaaacactgaaacacctttctctttgtcacttaattgagatgccgaagccacctcacaccatgaacttcatgaggtgtagcacccaaggcttccatagccatgcatactgaagaatgtctcaagctcagcaccctacttctgtgacgtgtccctcattcaccttcctctcttccctataaataaccacgcctcaggttctccgcttcacaactcaaacattctctccattggtccttaaacactcatcagtcatcaccgcggccgcaccatggtgaaaaggccagcacttccgctgaccgttgatggtgtcacctatgatgtgtctgcctggttgaaccatcatccagggggtgctgacatcattgagaactaccgcggtcgtgatgccactgatgtctttatggttatgcactctgaaaatgctgtgagtaaactaagaaggatgcctatcatggaaccatcatctccactgacgcctacgccaccgaaacccaactcagacgaaccgcaggaggatttccgcaagctccgagatgagctcatcgcagcaggaatgttcgacgcatcaccgatgtggtacgcatataagacgctcagtacgctgggcctcggggtcctcgcggtgctattgatgacccagtggcactggtacctcgtcggggcaatcgtgttgggcattcacttccaacaaatgggttggttgtcgcacgatatctgccaccatcagctgttcaaggaccgatcgatcaacaacgccatcggcttgcttttcgggaacgtcttgcaagggttctctgtgacctggtggaaggacaggcacaatgcacaccactccgccaccaacgtgcaaggccacgaccccgacattgacaacctgccgctgctggcatggtccaaggaggacgtggagagggccggcccgttctcacggcggatgatcaagtaccagcaatactacttcttcttcatctgtgccctcctgaggttcatctggtgcttccagagcatccacacagccacgggcctgaaggatcgcagcaaccagtactaccgcaggcagtacgagaaagagagcgtgggcctggccctccactggggcctgaaggcgttgttctactacttttatatgccaagcttcttgaccggactcatggtgtttttcgtgtccgagttgcttgggggcttcggcatcgccatcgtggtgttcatgaaccactaccccctggagaagatccaggactcggtgtgggacggccacggcttttgcgccggccagattcacgaaacgatgaacgtccagcggggactcgtcacggactggttcttcggtgggctgaattaccaaatcgagcaccacctgtggccgacgctgccccggcacaacctgacggcggccagcatcaaagtggagcagttgtgcaagaagcacaacttgccgtatcgcagccccccaatgctggagggggtgggcatcctgatcagctacctgggcacctttgcccgcatggtggcaaaggccgacaaggcgtaagc

SEQ ID NO: 164 - DNA, 7907 bp, Artificial Sequence
  plasmid pKR1178
ggagatccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcaccatggaagcagccaaagaattggtttccatcgtccaagaggagctccccaaggtggactatgcccagctttggcaggatgccagcagctgtgaggtcctttacctctcggtggcattcgtggcgatcaagttcatgctgcgcccactggacctgaagcgccaggccaccttgaagaagctgttcacagcatacaacttcctcatgtcgatctattcctttggctccttcctggccatggcctatgccctatcagtaactggcatcctctccggcgactgtgagacggcgttcaacaacgatgtgttcaggatcacaactcagctgttctacctcagcaagttcgtagagtacatcgactccttctaccttccccttatggacaagccactgtcgttccttcagttcttccatcatttgggggcccccattgacatgtggctattctacaaataccgcaacgaaggagtctggatctttgtcctgttgaatgggttcattcactggatcatgtacggttactattggacgcggctcatcaagctgaacttccccatgcccaagaacctgatcacctccatgcagatcatccagttcaatgtcgggttctacatcgtctggaagtaccgcaatgtgccatgctaccgccaggatgggatgcgcatgtttgcctggatcttcaactactggtatgtcgggacggtcttgctgctgttcctcaacttttacgtgcagacgtacatccggaagccgaggaagaaccgagggaagaaggagtagcggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttggcgcgcccgatcatccggatatagttcctcctttcagcaaaaaacccctcaagacccgtttagaggccccaaggggttatgctagttattgctcagcggtggcagcagccaactcagcttcctttcgggctttgttagcagccggatcgatccaagctgtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggcttttccatgggtatatctccttcttaaagttaaacaaaattatttctagagggaaaccgttgtggtctccctatagtgagtcgtattaatttcgcgggatcgagatctgatcaacctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatggacatattgtcgttagaacgcggctacaattaatacataaccttatgtatcatacacatacgatttaggtgacactatagaacggcgcgccgtcgacggatccgtacgagatccggccggccagatcctgcagcccgggggatcctctagacgtacgtgaaggttaaacatggtgaatatgttaccactagctgggatgcccattagatcaaaactgtaaaattctcccgtttcccttctattcacatgtgagccccctcccttttctttctttctcaattttgattgagttaaagtcaccagcaatgcatcactcaccctccaaaaaatttcttgtacaacttctcggactatcccaaagctccttttcctgagatggatggtcctgtctcttgcccttgatgtcttccttgttcgattttggcttcctctaatgtctttcttgctaggaatcaccacctcactcatctatgttgtcgtagcttctgaaagtctcatacatatccttagtgttgcactcatcttgtattgaagtgaaaaagaatgttgttctcctatccaaatctccattgaatctctttctcccaatgttgtcccatcggttggtcctcctctccaaccaattgtaaggtgtttaacataaacatggtacaattaagatttttcatttcattaagaaaagattgagatttgtggttctaaagtttcaattagagtttgatgatattgaaacaaccgtagaacacattaagtattactaacttatacatagagcattggaatttcaccttttatttattctgtttccgccaaaggtacatgactcaagttattttacacaagtaacaaaggcatctaagcctaagtattcttattcagacttttcattattactttcattgatttggtgcgaaatgcggccgcttacgccttgtcggcctttgccaccatgcgggcaaaggtgcccaggtagctgatcaggatgcccaccccctccagcattggggggctgcgatacggcaagttgtgcttcttgcacaactgctccactttgatgctggccgccgtcaggttgtgccggggcagcgtcggccacaggtggtgctcgatttggtaattcagcccaccgaagaaccagtccgtgacgagtccccgctggacgttcatcgtttcgtgaatctggccggcgcaaaagccgtggccgtcccacaccgagtcctggatcttctccagggggtagtggttcatgaacaccacgatggcgatgccgaagcccccaagcaactcggacacgaaaaacaccatgagtccggtcaagaagcttggcatataaaagtagtagaacaacgccttcaggccccagtggagggccaggcccacgctctctttctcgtactgcctgcggtagtactggttgctgcgatccttcaggcccgtggctgtgtggatgctctggaagcaccagatgaacctcaggagggcacagatgaagaagaagtagtattgctggtacttgatcatccgccgtgagaacgggccggccctctccacgtcctccttggaccatgccagcagcggcaggttgtcaatgtcggggtcgtggccttgcacgttggtggcggagtggtgtgcattgtgcctgtccttccaccaggtcacagagaacccttgcaagacgttcccgaaaagcaagccgatggcgttgttgatcgatcggtccttgaacagctgatggtggcagatatcgtgcgacaaccaacccatttgttggaagtgaatgcccaacacgattgccccgacgaggtaccagtgccactgggtcatcaatagcaccgcgaggaccccgaggcccagcgtactgagcgtcttatatgcgtaccacatcggtgatgcgtcgaacattcctgctgcgatgagctcatctcggagcttgcggaaatcctcctgcggttcgtctgagttgggtttcggtggcgtaggcgtcagtggagatgatggttccatgataggcatccttcttagtttactcacagcattttcagagtgcataaccataaagacatcagtggcatcacgaccgcggtagttctcaatgatgtcagcaccccctggatgatggttcaaccaggcagacacatcataggtgacaccatcaacggtcagcggaagtgctggccttttcaccatggtgcggccgcggtgatgactgatgagtgtttaaggaccaatggagagaatgtttgagttgtgaagcggagaacctgaggcgtggttatttatagggaagagaggaaggtgaatgagggacacgtcacagaagtagggtgctgagcttgagacattcttcagtatgcatggctatggaagccttgggtgctacacctcatgaagttcatggtgtgaggtggcttcggcatctcaattaagtgacaaagagaaaggtgtttcagtgtttctattgcaaatggcagaaactcgtgatgacgaggggaccatgcatggtttcatttcttttcttcctggattctttctttccttttatatatgcaggttcataatttaaaaattagactcgctttcaatttcttaatttctcattttcctcttatattactgtactaatgttaaccacgtacacttattttttttttagtttaattttgatagattgtgttgatttaaacatattaatattttcaaccaaataaaaatcattttagtagatacggctttttaaataattattaaaaatattaactatttatcctaaatggcacattttaattaaaaaaaatccggtgttgtaagtgttttattaatttgttttggcattattaaagcaactttttttttatttgttggcattttgagtacgtacttaggctagcctgca

SEQ ID NO: 165 - DNA, 29 bp, Artificial Sequence
  oligonucleotide oKti5
atctagacgtacgtcctcgaagagaaggg

SEQ ID NO: 166 - DNA, 27 bp, Artificial Sequence
  oligonucleotide oKti6
ttctagacgtacggatataatgagccg

SEQ ID NO: 167 - DNA, 4474 bp, Artificial Sequence
  plasmid pKR193
gtacgtctagaggatccccgggtaccgagctcgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttgcatgcctgcaggtcgactcgacgtacgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaac

SEQ ID NO: 168 - DNA, 5851 bp, Artificial Sequence
  plasmid pKR1174
ggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaaaggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggaacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacgtacgtctagaggatccccgggtaccgagctcgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttgcatgcctgcaggtcgactcgacgtacgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcaccatggccaccatctctttgactactgagcaacttttagaacacccagaactggttgcaattgatggggtgttgtacgatctcttcggactggcgaaagtgcatccaggtggcaacctcattgaagccgccggtgcctccgacggaaccgccctgttctactccatgcaccctggagtgaagccagagaattcgaagctgctgcagcaatttgcccgaggcaaacacgaacgaagctcgaaggacccagtgtacacctttgacagtcccttcgcccaggatgtcaagcagagcgttcgggaggtcatgaaggggcgcaactggtacgccacgcccggcttttggctgcggaccgcgctgatcatcgcgtgcactgccataggcgaatggtattggatcactaccggggcagtgatgtggggcatcttcaccgggtacttccacagccagattgggttggcgattcaacacgatgcctctcacggagccatcagcaaaaagccctgggtgaacgcctttttcgcctacggcatcgacgccattggatcctcccgctggatctggctgcagtcccacattatgcgccaccacacctacaccaaccagcatggcctggacctggacgctgcctcggcggagccgttcattttgttccactcctacccggcaacaaatgcgtcacgaaagtggtaccatcggttccaggcgtggtacatgtacatcgttttggggatgtatggtgtgtcgatggtgtacaatccgatgtacttgttcacgatgcagcacaacgacacaatcccagaggccacctctcttagaccaggcagctttttcaaccggcagcgcgccttcgccgtttccctccgcctactgttcatcttccgcaacgccttcctcccctggtacatcgcgggcgcctctccgctgctcaccatcctgctggtgccaacggtcacaggcatcttcttgacatttgtttttgtgctgtcccataactttgaaggcgctgagcggacccccgaaaagaactgcaaggccaaaagggccaaggaggggaaggaggtccgcgatgtagaggaggaccgggtggactggtaccgggcgcaggccgagaccgcggcgacctacgggggcagcgtcgggatgatgctgaccggcggtttgaacctgcagatcgagcaccacttgttcccccgcatgtcctcttggcactaccccttcatccaagatacggtgcgggaatgttgcaagcgccatggcgtgcgctacacatactacccgaccatcctggagaatataatgtccacgctccgctacatgcagaaggtgggcgtggcccacacaattcaggatgcccaggaattctgagc

SEQ ID NO: 169 - DNA, 11013 bp, Artificial Sequence
  plasmid pKR1186
gtacgtgaaggttaaacatggtgaatatgttaccactagctgggatgcccattagatcaaaactgtaaaattctcccgtttcccttctattcacatgtgagccccctcccttttctttctttctcaattttgattgagttaaagtcaccagcaatgcatcactcaccctccaaaaaatttcttgtacaacttctcggactatcccaaagctccttttcctgagatggatggtcctgtctcttgcccttgatgtcttccttgttcgattttggcttcctctaatgtctttcttgctaggaatcaccacctcactcatctatgttgtcgtagcttctgaaagtctcatacatatccttagtgttgcactcatcttgtattgaagtgaaaaagaatgttgttctcctatccaaatctccattgaatctctttctcccaatgttgtcccatcggttggtcctcctctccaaccaattgtaaggtgtttaacataaacatggtacaattaagatttttcatttcattaagaaaagattgagatttgtggttctaaagtttcaattagagtttgatgatattgaaacaaccgtagaacacattaagtattactaacttatacatagagcattggaatttcaccttttatttattctgtttccgccaaaggtacatgactcaagttattttacacaagtaacaaaggcatctaagcctaagtattcttattcagacttttcattattactttcattgatttggtgcgaaatgcggccgcttacgccttgtcggcctttgccaccatgcgggcaaaggtgcccaggtagctgatcaggatgcccaccccctccagcattggggggctgcgatacggcaagttgtgcttcttgcacaactgctccactttgatgctggccgccgtcaggttgtgccggggcagcgtcggccacaggtggtgctcgatttggtaattcagcccaccgaagaaccagtccgtgacgagtccccgctggacgttcatcgtttcgtgaatctggccggcgcaaaagccgtggccgtcccacaccgagtcctggatcttctccagggggtagtggttcatgaacaccacgatggcgatgccgaagcccccaagcaactcggacacgaaaaacaccatgagtccggtcaagaagcttggcatataaaagtagtagaacaacgccttcaggccccagtggagggccaggcccacgctctctttctcgtactgcctgcggtagtactggttgctgcgatccttcaggcccgtggctgtgtggatgctctggaagcaccagatgaacctcaggagggcacagatgaagaagaagtagtattgctggtacttgatcatccgccgtgagaacgggccggccctctccacgtcctccttggaccatgccagcagcggcaggttgtcaatgtcggggtcgtggccttgcacgttggtggcggagtggtgtgcattgtgcctgtccttccaccaggtcacagagaacccttgcaagacgttcccgaaaagcaagccgatggcgttgttgatcgatcggtccttgaacagctgatggtggcagatatcgtgcgacaaccaacccatttgttggaagtgaatgcccaacacgattgccccgacgaggtaccagtgccactgggtcatcaatagcaccgcgaggaccccgaggcccagcgtactgagcgtcttatatgcgtaccacatcggtgatgcgtcgaacattcctgctgcgatgagctcatctcggagcttgcggaaatcctcctgcggttcgtctgagttgggtttcggtggcgtaggcgtcagtggagatgatggttccatgataggcatccttcttagtttactcacagcattttcagagtgcataaccataaagacatcagtggcatcacgaccgcggtagttctcaatgatgtcagcaccccctggatgatggttcaaccaggcagacacatcataggtgacaccatcaacggtcagcggaagtgctggccttttcaccatggtgcggccgcggtgatgactgatgagtgtttaaggaccaatggagagaatgtttgagttgtgaagcggagaacctgaggcgtggttatttatagggaagagaggaaggtgaatgagggacacgtcacagaagtagggtgctgagcttgagacattcttcagtatgcatggctatggaagccttgggtgctacacctcatgaagttcatggtgtgaggtggcttcggcatctcaattaagtgacaaagagaaaggtgtttcagtgtttctattgcaaatggcagaaactcgtgatgacgaggggaccatgcatggtttcatttcttttcttcctggattctttctttccttttatatatgcaggttcataatttaaaaattagactcgctttcaatttcttaatttctcattttcctcttatattactgtactaatgttaaccacgtacacttattttttttttagtttaattttgatagattgtgttgatttaaacatattaatattttcaaccaaataaaaatcattttagtagatacggctttttaaataattattaaaaatattaactatttatcctaaatggcacattttaattaaaaaaaatccggtgttgtaagtgttttattaatttgttttggcattattaaagcaactttttttttatttgttggcattttgagtacgtacttaggctagcctgcaggagatccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcaccatggaagcagccaaagaattggtttccatcgtccaagaggagctccccaaggtggactatgcccagctttggcaggatgccagcagctgtgaggtcctttacctctcggtggcattcgtggcgatcaagttcatgctgcgcccactggacctgaagcgccaggccaccttgaagaagctgttcacagcatacaacttcctcatgtcgatctattcctttggctccttcctggccatggcctatgccctatcagtaactggcatcctctccggcgactgtgagacggcgttcaacaacgatgtgttcaggatcacaactcagctgttctacctcagcaagttcgtagagtacatcgactccttctaccttccccttatggacaagccactgtcgttccttcagttcttccatcatttgggggcccccattgacatgtggctattctacaaataccgcaacgaaggagtctggatctttgtcctgttgaatgggttcattcactggatcatgtacggttactattggacgcggctcatcaagctgaacttccccatgcccaagaacctgatcacctccatgcagatcatccagttcaatgtcgggttctacatcgtctggaagtaccgcaatgtgccatgctaccgccaggatgggatgcgcatgtttgcctggatcttcaactactggtatgtcgggacggtcttgctgctgttcctcaacttttacgtgcagacgtacatccggaagccgaggaagaaccgagggaagaaggagtagcggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttggcgcgcccgatcatccggatatagttcctcctttcagcaaaaaacccctcaagacccgtttagaggccccaaggggttatgctagttattgctcagcggtggcagcagccaactcagcttcctttcgggctttgttagcagccggatcgatccaagctgtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggcttttccatgggtatatctccttcttaaagttaaacaaaattatttctagagggaaaccgttgtggtctccctatagtgagtcgtattaatttcgcgggatcgagatctgatcaacctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatggacatattgtcgttagaacgcggctacaattaatacataaccttatgtatcatacacatacgatttaggtgacactatagaacggcgcgccgtcgacggatccgtacgttgaaacatccctgaagtgtctcattttattttatttattctttgctgataaaaaaataaaataaaagaagctaagcacacggtcaaccattgctctactgctaaaagggttatgtgtagtgttttactgcataaattatgcagcaaacaagacaactcaaattaaaaaatttcctttgcttgtttttttgttgtctctgacttgactttcttgtggaagttggttgtataaggattgggacaccattgtccttcttaatttaattttattctttgctgataaaaaaaaaaatttcatatagtgttaaataataatttgttaaataaccaaaaagtcaaatatgtttactctcgtttaaataattgagattcgttccagcaaggctaaacgattgtatagatttatgacaatatttacttttttatagataaatgttatattataataaatttatatacatatattatatgttatttattattattttaaatccttcaatattttatcaaaccaactcataattttttttttatctgtaagaagcaataaaattaaatagacccactttaaggatgatccaacctttatacagagtaagagagttcaaatagtaccttttcatatacatatcaactaaaatattagaaatatcatggatcaaaccttataaagacattaaataagtggataagtataatatataaatgggtagtatataatatataaatggatacaaacttctctctttataattgttatgtctccttaacatcctaatataatacataagtgggtaatatataatatataaatggagacaaacttcttccattataattgttatgtcttcttaacacttatgtctcgttcacaatgctaaggttagaattgtttagaaagtcttatagtacacatttgtttttgtactatttgaagcattccataagccgtcacgattcagatgatttataataataagaggaaatttatcatagaacaataaggtgcatagatagagtgttaatatatcataacatcctttgtttattcatagaagaagtgagatggagctcagttattatactgttacatggtcggatacaatattccatgctctccatgagctcttacacctacatgcattttagttcatacttgcggccgctcagaattcctgggcatcctgaattgtgtgggccacgcccaccttctgcatgtagcggagcgtggacattatattctccaggatggtcgggtagtatgtgtagcgcacgccatggcgcttgcaacattcccgcaccgtatcttggatgaaggggtagtgccaagaggacatgcgggggaacaagtggtgctcgatctgcaggttcaaaccgccggtcagcatcatcccgacgctgcccccgtaggtcgccgcggtctcggcctgcgcccggtaccagtccacccggtcctcctctacatcgcggacctccttcccctccttggcccttttggccttgcagttcttttcgggggtccgctcagcgccttcaaagttatgggacagcacaaaaacaaatgtcaagaagatgcctgtgaccgttggcaccagcaggatggtgagcagcggagaggcgcccgcgatgtaccaggggaggaaggcgttgcggaagatgaacagtaggcggagggaaacggcgaaggcgcgctgccggttgaaaaagctgcctggtctaagagaggtggcctctgggattgtgtcgttgtgctgcatcgtgaacaagtacatcggattgtacaccatcgacacaccatacatccccaaaacgatgtacatgtaccacgcctggaaccgatggtaccactttcgtgacgcatttgttgccgggtaggagtggaacaaaatgaacggctccgccgaggcagcgtccaggtccaggccatgctggttggtgtaggtgtggtggcgcataatgtgggactgcagccagatccagcgggaggatccaatggcgtcgatgccgtaggcgaaaaaggcgttcacccagggctttttgctgatggctccgtgagaggcatcgtgttgaatcgccaacccaatctggctgtggaagtacccggtgaagatgccccacatcactgccccggtagtgatccaataccattcgcctatggcagtgcacgcgatgatcagcgcggtccgcagccaaaagccgggcgtggcgtaccagttgcgccccttcatgacctcccgaacgctctgcttgacatcctgggcgaagggactgtcaaaggtgtacactgggtccttcgagcttcgttcgtgtttgcctcgggcaaattgctgcagcagcttcgaattctctggcttcactccagggtgcatggagtagaacagggcggttccgtcggaggcaccggcggcttcaatgaggttgccacctggatgcactttcgccagtccgaagagatcgtacaacaccccatcaattgcaaccagttctgggtgttctaaaagttgctcagtagtcaaagagatggtggccatggtgcggccgcagtatatcttaaattctttaatacggtgtactaggatattgaactggttcttgatgatgaaaacctgggccgagattgcagctatttatagtcataggtcttgttaacatgcatggacatttggccacggggtggcatgcagtttgacgggtgttgaaataaacaaaaatgaggtggcggaagagaatacgagtttgaggttgggttagaaacaacaaatgtgagggctcatgatgggttgagttggtgaatgttttgggctgctcgattgacacctttgtgagtacgtgttgttgtgcatggcttttggggtccagtttttttttcttgacgcggcgatcctgatcagctagtggataagtgatgtccactgtgtgtgattgcgtttttgtttgaattttatgaacttagacattgctatgcaaaggatactctcattgtgttttgtcttcttttgttccttggctttttcttatgatccaagagactagtcagtgttgtggcattcgagactaccaagattaattatgatgggggaaggataagtaactgattagtacggactgttaccaaattaattaataagcggcaaatgaagggcatggatc

SEQ ID NO: 170 - DNA, 21767 bp, Artificial Sequence
  plasmid pKR1193
cgcgccagatcctctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattggatcgatccctgaaagcgacgttggatgttaacatctacaaattgccttttcttatcgaccatgtacgtaagcgcttacgtttttggtggacccttgaggaaactggtagctgttgtgggcctgtggtctcaagatggatcattaatttccaccttcacctacgatggggggcatcgcaccggtgagtaatattgtacggctaagagcgaatttggcctgtagacctcaattgcgagctttctaatttcaaactattcgggcctaacttttggtgtgatgatgctgactggcaggatatataccgttgtaatttgagctcgtgtgaataagtcgctgtgtatgtttgtttgattgtttctgttggagtgcagcccatttcaccggacaagtcggctagattgatttagccctgatgaactgccgaggggaagccatcttgagcgcggaatgggaatggatttcgttgtacaacgagacgacagaacacccacgggaccgagcttcgcgagcttttgtatccgtggcatccttggtccgggcgatttgttcacgtccatgaggcgctctccaaaggaacgcatattttccggtgcaacctttccggttcttcctctactcgacctcttgaagtcccagcatgaatgttcgaccgctccgcaagcggatctttggcgcaaccagccggtttcgcacgtcgattctcgcgagcctgcatactttggcaagattgctgaatgacgctgatgcttcatcgcaatctgcgataatggggtaagtatccggtgaaggccgcaggtcaggccgcctgagcactcagtgtcttggatgtccagttccacggcagctgttgctcaagcctgctgatcggagcgtccgcaaggtcggcgcggacgtcggcaagccaggcctgcggatcgatgttattgagcttggcgctcatgatcagtgtcgccatgaacgccgcacgttcagcacaacgatccgatccggcaaacagccatgacttcctgccgagtacatagcctctgagcgttcgttcggcagcattgttcgtcaggcaaatcgggccgtcatcgaggaatgacgtaatgccatcccatcgcttgagcatgtaatttatcgcctcggcgacgggagaactgcgcgacaatttcccccgctcggtttcgagccaatcatgcagctcttcggcgagtgaccttgatcaggccaccgccacgaccgcggaagacgaacagatgcctgcgcatcggatcgcgcttcagcgtctcttgcaccatcagcgacaaaccgggaaagcctttgcgcatgtccgtacttatgtcgccacttgggagggcttcgtctacgtggccttcgtgatcgacgtcttcgcccgtcgcattgtcggatggcgggcgagccggacagcacatgcaggctttgtcctcgatgccctcgaggaggctcatcatgatcggcgtcccgctcatggcggcctagtgcatcactcggatcgcggtgttcaatacgtgtcctttcgctattccgagcggttggcagaagcaggtatcgagccatctatcggaagcgtcggcgacagcacgacaacgccctcgcagaagcgatcaacggtctttacaaggccgaggtcattcatcggcgtggaccatggaggagcttcgaagcggtcgagttcgctaccttggaatggatagactggttcaaccacggcggcttttgaagcccatcggcaatataccgccagccgaagacgaggatcagtattacgccatgctggacgaagcagccatggctgcgcattttaacgaaatggcctccggcaaacccggtgcggttcacttgttgcgtgggaaagttcacgggactccgcgcacgagccttcttcgtaatagccatatcgaccgaattgacctgcaggggggggggggaaagccacgttgtgtctcaaaatctctgatgttacattgcacaagataaaaatatatcatcatgaacaataaaactgtctgcttacataaacagtaatacaaggggtgttatgagccatattcaacgggaaacgtcttgctcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccgggaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacactggcagagcattacgctgacttgacgggacggcggctttgttgaataaatcgaacttttgctgagttgaaggatcagatcacgcatcttcccgacaacgcagaccgttccgtggcaaagcaaaagttcaaaatcaccaactggtccacctacaacaaagctctcatcaaccgtggctccctcactttctggctggatgatggggcgattcaggcctggtatgagtcagcaacaccttcttcacgaggcagacctcagcgcccccccccccctgcaggtcttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagggtgccttgatgtgggcgccggcggtcgagtggcgacggcgcggcttgtccgcgccctggtagattgcctggccgtaggccagccatttttgagcggccagcggccgcgataggccgacgcgaagcggcggggcgtagggagcgcagcgaccgaagggtaggcgctttttgcagctcttcggctgtgcgctggccagacagttatgcacaggccaggcgggttttaagagttttaataagttttaaagagttttaggcggaaaaatcgccttttttctcttttatatcagtcacttacatgtgtgaccggttcccaatgtacggctttgggttcccaatgtacgggttccggttcccaatgtacggctttgggttcccaatgtacgtgctatccacaggaaagagaccttttcgacctttttcccctgctagggcaatttgccctagcatctgctccgtacattaggaaccggcggatgcttcgccctcgatcaggttgcggtagcgcatgactaggatcgggccagcctgccccgcctcctccttcaaatcgtactccggcaggtcatttgacccgatcagcttgcgcacggtgaaacagaacttcttgaactctccggcgctgccactgcgttcgtagatcgtcttgaacaaccatctggcttctgccttgcctgcggcgcggcgtgccaggcggtagagaaaacggccgatgccgggatcgatcaaaaagtaatcggggtgaaccgtcagcacgtccgggttcttgccttctgtgatctcgcggtacatccaatcagctagctcgatctcgatgtactccggccgcccggtttcgctctttacgatcttgtagcggctaatcaaggcttcaccctcggataccgtcaccaggcggccgttcttggccttcttcgtacgctgcatggcaacgtgcgtggtgtttaaccgaatgcaggtttctaccaggtcgtctttctgctttccgccatcggctcgccggcagaacttgagtacgtccgcaacgtgtggacggaacacgcggccgggcttgtctcccttcccttcccggtatcggttcatggattcggttagatgggaaaccgccatcagtaccaggtcgtaatcccacacactggccatgccggccggccctgcggaaacctctacgtgcccgtctggaagctcgtagcggatcacctcgccagctcgtcggtcacgcttcgacagacggaaaacggccacgtccatgatgctgcgactatcgcgggtgcccacgtcatagagcatcggaacgaaaaaatctggttgctcgtcgcccttgggcggcttcctaatcgacggcgcaccggctgccggcggttgccgggattctttgcggattcgatcagcggccgcttgccacgattcaccggggcgtgcttctgcctcgatgcgttgccgctgggcggcctgcgcggccttcaacttctccaccaggtcatcacccagcgccgcgccgatttgtaccgggccggatggtttgcgaccgctcacgccgattcctcgggcttgggggttccagtgccattgcagggccggcagacaacccagccgcttacgcctggccaaccgcccgttcctccacacatggggcattccacggcgtcggtgcctggttgttcttgattttccatgccgcctcctttagccgctaaaattcatctactcatttattcatttgctcatttactctggtagctgcgcgatgtattcagatagcagctcggtaatggtcttgccttggcgtaccgcgtacatcttcagcttggtgtgatcctccgccggcaactgaaagttgacccgcttcatggctggcgtgtctgccaggctggccaacgttgcagccttgctgctgcgtgcgctcggacggccggcacttagcgtgtttgtgcttttgctcattttctctttacctcattaactcaaatgagttttgatttaatttcagcggccagcgcctggacctcgcgggcagcgtcgccctcgggttctgattcaagaacggttgtgccggcggcggcagtgcctgggtagctcacgcgctgcgtgatacgggactcaagaatgggcagctcgtacccggccagcgcctcggcaacctcaccgccgatgcgcgtgcctttgatcgcccgcgacacgacaaaggccgcttgtagccttccatccgtgacctcaatgcgctgcttaaccagctccaccaggtcggcggtggcccatatgtcgtaagggcttggctgcaccggaatcagcacgaagtcggctgccttgatcgcggacacagccaagtccgccgcctggggcgctccgtcgatcactacgaagtcgcgccggccgatggccttcacgtcgcggtcaatcgtcgggcggtcgatgccgacaacggttagcggttgatcttcccgcacggccgcccaatcgcgggcactgccctggggatcggaatcgactaacagaacatcggccccggcgagttgcagggcgcgggctagatgggttgcgatggtcgtcttgcctgacccgcctttctggttaagtacagcgataacttcatgcgttcccttgcgtatttgtttatttactcatcgcatcatatacgcagcgaccgcatgacgcaagctgttttactcaaatacacatcacctttttagacggcggcgctcggtttcttcagcggccaagctggccggccaggccgccagcttggcatcagacaaaccggccaggatttcatgcagccgcacggttgagacgtgcgcgggcggctcgaacacgtacccggccgcgatcatctccgcctcgatctcttcggtaatgaaaaacggttcgtcctggccgtcctggtgcggtttcatgcttgttcctcttggcgttcattctcggcggccgccagggcgtcggcctcggtcaatgcgtcctcacggaaggcaccgcgccgcctggcctcggtgggcgtcacttcctcgctgcgctcaagtgcgcggtacagggtcgagcgatgcacgccaagcagtgcagccgcctctttcacggtgcggccttcctggtcgatcagctcgcgggcgtgcgcgatctgtgccggggtgagggtagggcgggggccaaacttcacgcctcgggccttggcggcctcgcgcccgctccgggtgcggtcgatgattagggaacgctcgaactcggcaatgccggcgaacacggtcaacaccatgcggccggccggcgtggtggtgtcggcccacggctctgccaggctacgcaggcccgcgccggcctcctggatgcgctcggcaatgtccagtaggtcgcgggtgctgcgggccaggcggtctagcctggtcactgtcacaacgtcgccagggcgtaggtggtcaagcatcctggccagctccgggcggtcgcgcctggtgccggtgatcttctcggaaaacagcttggtgcagccggccgcgtgcagttcggcccgttggttggtcaagtcctggtcgtcggtgctgacgcgggcatagcccagcaggccagcggcggcgctcttgttcatggcgtaatgtctccggttctagtcgcaagtattctactttatgcgactaaaacacgcgacaagaaaacgccaggaaaagggcagggcggcagcctgtcgcgtaacttaggacttgtgcgacatgtcgttttcagaagacggctgcactgaacgtcagaagccgactgcactatagcagcggaggggttggaccacaggacgggtgtggtcgccatgatcgcgtagtcgatagtggctccaagtagcgaagcgagcaggactgggcggcggccaaagcggtcggacagtgctccgagaacgggtgcgcatagaaattgcatcaacgcatatagcgctagcagcacgccatagtgactggcgatgctgtcggaatggacgatatcccgcaagaggcccggcagtaccggcataaccaagcctatgcctacagcatccagggtgacggtgccgaggatgacgatgagcgcattgttagatttcatacacggtgcctgactgcgttagcaatttaactgtgataaactaccgcattaaagctagcttgcttggtcgttccgcgtgaacgtcggctcgattgtacctgcgttcaaatactttgcgatcgtgttgcgcgcctgcccggtgcgtcggctgatctcacggatcgactgcttctctcgcaacgccatccgacggatgatgtttaaaagtcccatgtggatcactccgttgccccgtcgctcaccgtgttggggggaaggtgcacatggctcagttctcaatggaaattatctgcctaaccggctcagttctgcgtagaaaccaacatgcaagctccaccgggtgcaaagcggcagcggcggcaggatatattcaattgtaaatggcttcatgtccgggaaatctacatggatcagcaatgagtatgatggtcaatatggagaaaaagaaagagtaattaccaattttttttcaattcaaaaatgtagatgtccgcagcgttattataaaatgaaagtacattttgataaaacgacaaattacgatccgtcgtatttataggcgaaagcaataaacaaattattctaattcggaaatctttatttcgacgtgtctacattcacgtccaaatgggggcttagatgagaaacttcacgatcgatgccttgatttcgccattcccagatacccatttcatcttcagattggtctgagattatgcgaaaatatacactcatatacataaatactgacagtttgagctaccaattcagtgtagcccattacctcacataattcactcaaatgctaggcagtctgtcaactcggcgtcaatttgtcggccactatacgatagttgcgcaaattttcaaagtcctggcctaacatcacacctctgtcggcggcgggtcccatttgtgataaatccaccatatcgaattaattcagactcctttgccccagagatcacaatggacgacttcctctatctctacgatctagtcaggaagttcgacggagaaggtgacgataccatgttcaccactgataatgagaagattagccttttcaatttcagaaagaatgctaacccacagatggttagagaggcttacgcagcaggtctcatcaagacgatctacccgagcaataatctccaggagatcaaataccttcccaagaaggttaaagatgcagtcaaaagattcaggactaactgcatcaagaacacagagaaagatatatttctcaagatcagaagtactattccagtatggacgattcaaggcttgcttcacaaaccaaggcaagtaatagagattggagtctctaaaaaggtagttcccactgaatcaaaggccatggagtcaaagattcaaatagaggacctaacagaactcgccgtaaagactggcgaacagttcatacagagtctcttacgactcaatgacaagaagaaaatcttcgtcaacatggtggagcacgacacgcttgtctactccaaaaatatcaaagatacagtctcagaagaccaaagggcaattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagaggacacgctgaaatcaccagtctccaagcttgcggggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccggatcgatccaacacttacgtttgcaacgtccaagagcaaatagaccacgaacgccggaaggttgccgcagcgtgtggattgcgtctcaattctctcttgcaggaatgcaatgatgaatatgatactgactatgaaactttgagggaatactgcctagcaccgtcacctcataacgtgcatcatgcatgccctgacaacatggaacatcgctatttttctgaagaattatgctcgttggaggatgtcgcggcaattgcagctattgccaacatcgaactacccctcacgcatgcattcatcaatattattcatgcggggaaaggcaagattaatccaactggcaaatcatccagcgtgattggtaacttcagttccagcgacttgattcgttttggtgctacccacgttttcaataaggacgagatggtggagtaaagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgatcaaacttcggtactgtgtaatgacgatgagcaatcgagaggctgactaacaaaaggtacatcgcgatggatcgatccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcctgcagcccgggggatccgcccactcgaggcgcgccgtcgacggatccgtacgttgaaacatccctgaagtgtctcattttattttatttattctttgctgataaaaaaataaaataaaagaagctaagcacacggtcaaccattgctctactgctaaaagggttatgtgtagtgttttactgcataaattatgcagcaaacaagacaactcaaattaaaaaatttcctttgcttgtttttttgttgtctctgacttgactttcttgtggaagttggttgtataaggattgggacaccattgtccttcttaatttaattttattctttgctgataaaaaaaaaaatttcatatagtgttaaataataatttgttaaataaccaaaaagtcaaatatgtttactctcgtttaaataattgagattcgttccagcaaggctaaacgattgtatagatttatgacaatatttacttttttatagataaatgttatattataataaatttatatacatatattatatgttatttattattattttaaatccttcaatattttatcaaaccaactcataattttttttttatctgtaagaagcaataaaattaaatagacccactttaaggatgatccaacctttatacagagtaagagagttcaaatagtaccttttcatatacatatcaactaaaatattagaaatatcatggatcaaaccttataaagacattaaataagtggataagtataatatataaatgggtagtatataatatataaatggatacaaacttctctctttataattgttatgtctccttaacatcctaatataatacataagtgggtaatatataatatataaatggagacaaacttcttccattataattgttatgtcttcttaacacttatgtctcgttcacaatgctaaggttagaattgtttagaaagtcttatagtacacatttgtttttgtactatttgaagcattccataagccgtcacgattcagatgatttataataataagaggaaatttatcatagaacaataaggtgcatagatagagtgttaatatatcataacatcctttgtttattcatagaagaagtgagatggagctcagttattatactgttacatggtcggatacaatattccatgctctccatgagctcttacacctacatgcattttagttcatacttgcggccgctcagaattcctgggcatcctgaattgtgtgggccacgcccaccttctgcatgtagcggagcgtggacattatattctccaggatggtcgggtagtatgtgtagcgcacgccatggcgcttgcaacattcccgcaccgtatcttggatgaaggggtagtgccaagaggacatgcgggggaacaagtggtgctcgatctgcaggttcaaaccgccggtcagcatcatcccgacgctgcccccgtaggtcgccgcggtctcggcctgcgcccggtaccagtccacccggtcctcctctacatcgcggacctccttcccctccttggcccttttggccttgcagttcttttcgggggtccgctcagcgccttcaaagttatgggacagcacaaaaacaaatgtcaagaagatgcctgtgaccgttggcaccagcaggatggtgagcagcggagaggcgcccgcgatgtaccaggggaggaaggcgttgcggaagatgaacagtaggcggagggaaacggcgaaggcgcgctgccggttgaaaaagctgcctggtctaagagaggtggcctctgggattgtgtcgttgtgctgcatcgtgaacaagtacatcggattgtacaccatcgacacaccatacatccccaaaacgatgtacatgtaccacgcctggaaccgatggtaccactttcgtgacgcatttgttgccgggtaggagtggaacaaaatgaacggctccgccgaggcagcgtccaggtccaggccatgctggttggtgtaggtgtggtggcgcataatgtgggactgcagccagatccagcgggaggatccaatggcgtcgatgccgtaggcgaaaaaggcgttcacccagggctttttgctgatggctccgtgagaggcatcgtgttgaatcgccaacccaatctggctgtggaagtacccggtgaagatgccccacatcactgccccggtagtgatccaataccattcgcctatggcagtgcacgcgatgatcagcgcggtccgcagccaaaagccgggcgtggcgtaccagttgcgccccttcatgacctcccgaacgctctgcttgacatcctgggcgaagggactgtcaaaggtgtacactgggtccttcgagcttcgttcgtgtttgcctcgggcaaattgctgcagcagcttcgaattctctggcttcactccagggtgcatggagtagaacagggcggttccgtcggaggcaccggcggcttcaatgaggttgccacctggatgcactttcgccagtccgaagagatcgtacaacaccccatcaattgcaaccagttctgggtgttctaaaagttgctcagtagtcaaagagatggtggccatggtgcggccgcagtatatcttaaattctttaatacggtgtactaggatattgaactggttcttgatgatgaaaacctgggccgagattgcagctatttatagtcataggtcttgttaacatgcatggacatttggccacggggtggcatgcagtttgacgggtgttgaaataaacaaaaatgaggtggcggaagagaatacgagtttgaggttgggttagaaacaacaaatgtgagggctcatgatgggttgagttggtgaatgttttgggctgctcgattgacacctttgtgagtacgtgttgttgtgcatggcttttggggtccagtttttttttcttgacgcggcgatcctgatcagctagtggataagtgatgtccactgtgtgtgattgcgtttttgtttgaattttatgaacttagacattgctatgcaaaggatactctcattgtgttttgtcttcttttgttccttggctttttcttatgatccaagagactagtcagtgttgtggcattcgagactaccaagattaattatgatgggggaaggataagtaactgattagtacggactgttaccaaattaattaataagcggcaaatgaagggcatggatcgtacgtgaaggttaaacatggtgaatatgttaccactagctgggatgcccattagatcaaaactgtaaaattctcccgtttcccttctattcacatgtgagccccctcccttttctttctttctcaattttgattgagttaaagtcaccagcaatgcatcactcaccctccaaaaaatttcttgtacaacttctcggactatcccaaagctccttttcctgagatggatggtcctgtctcttgcccttgatgtcttccttgttcgattttggcttcctctaatgtctttcttgctaggaatcaccacctcactcatctatgttgtcgtagcttctgaaagtctcatacatatccttagtgttgcactcatcttgtattgaagtgaaaaagaatgttgttctcctatccaaatctccattgaatctctttctcccaatgttgtcccatcggttggtcctcctctccaaccaattgtaaggtgtttaacataaacatggtacaattaagatttttcatttcattaagaaaagattgagatttgtggttctaaagtttcaattagagtttgatgatattgaaacaaccgtagaacacattaagtattactaacttatacatagagcattggaatttcaccttttatttattctgtttccgccaaaggtacatgactcaagttattttacacaagtaacaaaggcatctaagcctaagtattcttattcagacttttcattattactttcattgatttggtgcgaaatgcggccgcttacgccttgtcggcctttgccaccatgcgggcaaaggtgcccaggtagctgatcaggatgcccaccccctccagcattggggggctgcgatacggcaagttgtgcttcttgcacaactgctccactttgatgctggccgccgtcaggttgtgccggggcagcgtcggccacaggtggtgctcgatttggtaattcagcccaccgaagaaccagtccgtgacgagtccccgctggacgttcatcgtttcgtgaatctggccggcgcaaaagccgtggccgtcccacaccgagtcctggatcttctccagggggtagtggttcatgaacaccacgatggcgatgccgaagcccccaagcaactcggacacgaaaaacaccatgagtccggtcaagaagcttggcatataaaagtagtagaacaacgccttcaggccccagtggagggccaggcccacgctctctttctcgtactgcctgcggtagtactggttgctgcgatccttcaggcccgtggctgtgtggatgctctggaagcaccagatgaacctcaggagggcacagatgaagaagaagtagtattgctggtacttgatcatccgccgtgagaacgggccggccctctccacgtcctccttggaccatgccagcagcggcaggttgtcaatgtcggggtcgtggccttgcacgttggtggcggagtggtgtgcattgtgcctgtccttccaccaggtcacagagaacccttgcaagacgttcccgaaaagcaagccgatggcgttgttgatcgatcggtccttgaacagctgatggtggcagatatcgtgcgacaaccaacccatttgttggaagtgaatgcccaacacgattgccccgacgaggtaccagtgccactgggtcatcaatagcaccgcgaggaccccgaggcccagcgtactgagcgtcttatatgcgtaccacatcggtgatgcgtcgaacattcctgctgcgatgagctcatctcggagcttgcggaaatcctcctgcggttcgtctgagttgggtttcggtggcgtaggcgtcagtggagatgatggttccatgataggcatccttcttagtttactcacagcattttcagagtgcataaccataaagacatcagtggcatcacgaccgcggtagttctcaatgatgtcagcaccccctggatgatggttcaaccaggcagacacatcataggtgacaccatcaacggtcagcggaagtgctggccttttcaccatggtgcggccgcggtgatgactgatgagtgtttaaggaccaatggagagaatgtttgagttgtgaagcggagaacctgaggcgtggttatttatagggaagagaggaaggtgaatgagggacacgtcacagaagtagggtgctgagcttgagacattcttcagtatgcatggctatggaagccttgggtgctacacctcatgaagttcatggtgtgaggtggcttcggcatctcaattaagtgacaaagagaaaggtgtttcagtgtttctattgcaaatggcagaaactcgtgatgacgaggggaccatgcatggtttcatttcttttcttcctggattctttctttccttttatatatgcaggttcataatttaaaaattagactcgctttcaatttcttaatttctcattttcctcttatattactgtactaatgttaaccacgtacacttattttttttttagtttaattttgatagattgtgttgatttaaacatattaatattttcaaccaaataaaaatcattttagtagatacggctttttaaataattattaaaaatattaactatttatcctaaatggcacattttaattaaaaaaaatccggtgttgtaagtgttttattaatttgttttggcattattaaagcaactttttttttatttgttggcattttgagtacgtacttaggctagcctgcaggagatccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcaccatggaagcagccaaagaattggtttccatcgtccaagaggagctccccaaggtggactatgcccagctttggcaggatgccagcagctgtgaggtcctttacctctcggtggcattcgtggcgatcaagttcatgctgcgcccactggacctgaagcgccaggccaccttgaagaagctgttcacagcatacaacttcctcatgtcgatctattcctttggctccttcctggccatggcctatgccctatcagtaactggcatcctctccggcgactgtgagacggcgttcaacaacgatgtgttcaggatcacaactcagctgttctacctcagcaagttcgtagagtacatcgactccttctaccttccccttatggacaagccactgtcgttccttcagttcttccatcatttgggggcccccattgacatgtggctattctacaaataccgcaacgaaggagtctggatctttgtcctgttgaatgggttcattcactggatcatgtacggttactattggacgcggctcatcaagctgaacttccccatgcccaagaacctgatcacctccatgcagatcatccagttcaatgtcgggttctacatcgtctggaagtaccgcaatgtgccatgctaccgccaggatgggatgcgcatgtttgcctggatcttcaactactggtatgtcgggacggtcttgctgctgttcctcaacttttacgtgcagacgtacatccggaagccgaggaagaaccgagggaagaaggagtagcggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttgg

SEQ ID NO: 171 - DNA, 20 bp, Artificial Sequence
  primer SeqE
cgacacactccaatctttcc

SEQ ID NO: 172 - DNA, 20 bp, Artificial Sequence
  primer SeqW
ggtggctggagttagacatc

What is claimed is:

1. A transgenic oilseed plant comprising:
   (a) a first recombinant construct comprising at least one regulatory sequence operably linked to a polynucleotide encoding at least one delta-8 desaturase polypeptide;
   (b) a second recombinant construct comprising at least one regulatory sequence operably linked to a polynucleotide encoding at least one delta-9 elongase polypeptide;
   (c) a third recombinant construct comprising at least one regulatory sequence operably linked to a polynucleotide encoding at least one delta-5 desaturase polypeptide; and
   (d) decreased delta-15 desaturase activity relative to a wild-type or non-transformed plant;
   wherein the transgenic oilseed plant produces mature seeds in which the total seed fatty acid profile comprises at least 10.0% arachidonic acid and less than 5% total omega-3 fatty acids having at least eighteen carbon atoms and at least four double bonds.

2. A transgenic oilseed plant comprising:
   (a) a first recombinant construct comprising at least one regulatory sequence operably linked to a polynucleotide encoding at least one delta-8 desaturase polypeptide;
   (b) a second recombinant construct comprising at least one regulatory sequence operably linked to a polynucleotide encoding at least one delta-9 elongase polypeptide;
   (c) a third recombinant construct comprising at least one regulatory sequence operably linked to a polynucleotide encoding at least one delta-5 desaturase polypeptide; and
   (d) decreased delta-15 desaturase activity relative to a wild-type or non-transformed plant;
   wherein the transgenic oilseed plant produces mature seeds in which the total seed fatty acid profile comprises at least 10.0% arachidonic acid and less than 1% total omega-3 fatty acids having at least eighteen carbon atoms and at least four double bonds.

3. The transgenic plant of claim 1 or claim 2 wherein the oilseed plant is selected from the group consisting of soybean, *Brassica* species, sunflower, maize, cotton, flax, and safflower.

4. Seeds obtained from the transgenic plant of claim 1 or claim 2.

5. A pet food which has incorporated therein the seeds of claim 4.

6. Aquafeed which has incorporated therein the seeds of claim 4.

7. Animal feed which as incorporated therein the seeds of claim 4.

8. A whole seed product made from the seeds of claim 4.

9. The transgenic plant of claim 1 or claim 2, wherein the decrease of delta-15 desaturase activity is accomplished by introduction of a recombinant construct comprising an isolated polynucleotide encoding at least one fad3 or fad3c polynucleotide fragment operably linked to at least one regulatory sequence.

10. The transgenic plant of claim 9, wherein the isolated polynucleotide encodes at least one fad3 or fad3c polynucleotide fragment that encodes a hairpin structure.

11. The transgenic plant of claim 1 or claim 2, wherein the decrease in delta-15 desaturase activity is accomplished by at least one mutation in an endogenous delta-15 desaturase gene.

* * * * *